(12) United States Patent
Liu et al.

(10) Patent No.: US 7,585,849 B2
(45) Date of Patent: Sep. 8, 2009

(54) POSITION DEPENDENT RECOGNITION OF GNN NUCLEOTIDE TRIPLETS BY ZINC FINGERS

(75) Inventors: Qiang Liu, Foster City, CA (US); Edward Rebar, El Cerrito, CA (US); Andrew C. Jamieson, San Francisco, CA (US)

(73) Assignee: Sangamo Biosciences, Inc., Richmond, CA (US)

( * ) Notice: Subject to any disclaimer, the term of this patent is extended or adjusted under 35 U.S.C. 154(b) by 196 days.

(21) Appl. No.: 11/202,009

(22) Filed: Aug. 11, 2005

(65) Prior Publication Data
US 2006/0024726 A1  Feb. 2, 2006

Related U.S. Application Data

(63) Continuation of application No. 09/989,994, filed on Nov. 20, 2001, now abandoned, which is a continuation-in-part of application No. 09/716,637, filed on Nov. 20, 2000, now Pat. No. 6,794,136, and a continuation-in-part of application No. 09/535,088, filed on Mar. 23, 2000, now abandoned.

(60) Provisional application No. 60/126,238, filed on Mar. 24, 1999, provisional application No. 60/126,239, filed on Mar. 24, 1999, provisional application No. 60/146,595, filed on Jul. 30, 1999, provisional application No. 60/146,615, filed on Jul. 30, 1999.

(51) Int. Cl.
| | |
|---|---|
| A01N 43/04 | (2006.01) |
| A01N 65/00 | (2006.01) |
| A61K 31/70 | (2006.01) |
| A61K 38/00 | (2006.01) |
| C12N 15/00 | (2006.01) |
| C07K 5/00 | (2006.01) |
| C07K 7/00 | (2006.01) |
| C07K 16/00 | (2006.01) |
| C07K 17/00 | (2006.01) |
| C12Q 1/68 | (2006.01) |
| C07H 21/02 | (2006.01) |
| C07H 21/04 | (2006.01) |

(52) U.S. Cl. ............ 514/44; 424/93.1; 435/320.1; 435/6; 530/333; 530/421; 536/23.1; 536/24.3

(58) Field of Classification Search ............ None
See application file for complete search history.

(56) References Cited

U.S. PATENT DOCUMENTS

| | | |
|---|---|---|
| 4,990,607 A | 2/1991 | Katagiri et al. |
| 5,096,814 A | 3/1992 | Aivasidis et al. |
| 5,096,815 A | 3/1992 | Ladner et al. |
| 5,198,346 A | 3/1993 | Ladner et al. |
| 5,223,409 A | 6/1993 | Ladner et al. |
| 5,243,041 A | 9/1993 | Fernandez-Pol |
| 5,302,519 A | 4/1994 | Blackwood et al. |
| 5,324,638 A | 6/1994 | Tao et al. |
| 5,324,818 A | 6/1994 | Nabel et al. |
| 5,324,819 A | 6/1994 | Oppermann et al. |
| 5,340,739 A | 8/1994 | Stevens et al. |
| 5,348,864 A | 9/1994 | Barbacid et al. |
| 5,350,840 A | 9/1994 | Call et al. |
| 5,356,802 A | 10/1994 | Chandrasegaran |
| 5,376,530 A | 12/1994 | De The et al. |
| 5,403,484 A | 4/1995 | Ladner |
| 5,436,150 A | 7/1995 | Chandrasegaran |
| 5,487,994 A | 1/1996 | Chandrasegaran |
| 5,498,530 A | 3/1996 | Schatz et al. |
| 5,578,483 A | 11/1996 | Evans |
| 5,597,693 A | 1/1997 | Evans et al. |
| 5,639,592 A | 6/1997 | Evans et al. |
| 5,674,738 A | 10/1997 | Abramson et al. |
| 5,702,914 A | 12/1997 | Evans et al. |
| 5,789,538 A | 8/1998 | Rebar et al. |
| 5,792,640 A | 8/1998 | Chandrasegaran |
| 5,830,721 A | 11/1998 | Stemmer et al. |
| 5,869,618 A | 2/1999 | Lippman et al. |

(Continued)

FOREIGN PATENT DOCUMENTS

| | | |
|---|---|---|
| EP | 0 875 567 A2 | 11/1998 |
| WO | WO 92/02536 | 2/1992 |
| WO | WO 95/11922 | 5/1995 |

(Continued)

OTHER PUBLICATIONS

Liu et al, JBC, 277(6):3850-3856, 2002.*
Goncalves, Bioessays. 27(5):506-517, 2005.*
Juengst, BMJ, 326:1410-11, 2003.*
Check Nature 422:7, 2003.*
Couzin et al, Science 307:1028, 2005.*
Wolf, Nat. Biotechnol. 20, 768-769, 2002.*
Rosenberg et al, Science 287:1751, 2000.*
Touchette, Nat. Med. 2(1) 7-8, 1996.*

(Continued)

*Primary Examiner*—Robert M Kelly
(74) *Attorney, Agent, or Firm*—Robins & Pasternak LLP

(57) ABSTRACT

The specificity of binding of a zinc finger to a triplet or quadruplet nucleotide target subsite depends upon the location of the zinc finger in a multifinger protein and, hence, upon the location of its target subsite within a larger target sequence. The present disclosure provides zinc finger amino acid sequences for recognition of triplet target subsites having the nucleotide G in the 5'-most position of the subsite, that have been optimized with respect to the location of the subsite within the target site. Accordingly, the disclosure provides finger position-specific amino acid sequences for the recognition of GNN target subsites. This allows the construction of multi-finger zinc finger proteins with improved affinity and specificity for their target sequences, as well as enhanced biological activity.

2 Claims, 4 Drawing Sheets

U.S. PATENT DOCUMENTS

| | | | |
|---|---|---|---|
| 5,871,902 | A | 2/1999 | Weininger et al. |
| 5,871,907 | A | 2/1999 | Winter et al. |
| 5,916,794 | A | 6/1999 | Chandrasegaran |
| 5,939,538 | A | 8/1999 | Leavitt et al. |
| 5,972,615 | A | 10/1999 | An et al. |
| 6,001,885 | A | 12/1999 | Vega et al. |
| 6,007,988 | A | 12/1999 | Choo et al. |
| 6,013,453 | A | 1/2000 | Choo et al. |
| 6,140,081 | A | 10/2000 | Barbas, III et al. |
| 6,160,091 | A | 12/2000 | Peukart et al. |
| 6,453,242 | B1 | 9/2002 | Eisenberg |
| 6,503,717 | B2 | 1/2003 | Case |
| 2003/0021776 | A1 | 1/2003 | Rebar et al. |

FOREIGN PATENT DOCUMENTS

| | | |
|---|---|---|
| WO | WO 95/19431 | 7/1995 |
| WO | WO 96/06110 | 2/1996 |
| WO | WO 96/06166 | 2/1996 |
| WO | WO 96/11267 | 4/1996 |
| WO | WO 96/20951 | 7/1996 |
| WO | WO 96/32475 | 10/1996 |
| WO | WO 97/27212 | 7/1997 |
| WO | WO 97/27213 | 7/1997 |
| WO | WO 98/53057 | 11/1998 |
| WO | WO 98/53058 | 11/1998 |
| WO | WO 98/53059 | 11/1998 |
| WO | WO 98/53060 | 11/1998 |
| WO | WO 98/54311 | 12/1998 |
| WO | WO 99/36553 | 7/1999 |
| WO | WO 99/41371 | 8/1999 |
| WO | WO 99/42474 | 8/1999 |
| WO | WO 99/45132 | 9/1999 |
| WO | WO 99/47656 | 9/1999 |
| WO | WO 99/48909 | 9/1999 |
| WO | WO 00/23464 | 4/2000 |
| WO | WO 00/27878 | 5/2000 |
| WO | WO 00/41566 | 7/2000 |
| WO | WO 00/42219 A1 | 7/2000 |
| WO | WO 01/40798 A2 | 6/2001 |
| WO | WO 01/59450 A3 | 8/2001 |
| WO | WO 02/46412 A2 | 6/2002 |

OTHER PUBLICATIONS

Agarwal et al., "Stimulation of Transcript Elongation Requires Both the Zinc Finger and RNA Polymerase II Binding Domains of Human TFIIS," Biochemistry 30(31): 7842-7851 (1991).

Antao et al., "A Thermodynamic Study of Unusually Stable RNA and DNA Hairpins," Nuc. Acids. Res. 19(21): 5901-5905 (1991).

Barbas, C.F. "Recent Advances in Phage Display," Curr. Opin. Biotech. 4: 526-530 (1993).

Barbas et al., "Assembly of Combinatorial Antibody Libraries on Phage Surfaces: the Gene III Site," PNAS 88: 7978-7982 (1991).

Barbas et al., "Semisynthetic Combinatorial Antibody Libraries: A Chemical Solution to the Diversity Problem," PNAS 89: 4457-4461 (1992).

Beerli et al., "Toward Controlling Gene Expression at Will: Specific Regulation of the ERBB-2/HER-2 Promoter by Using Polydactyl Zinc Finger Proteins Constructed From Modular Building Blocks," PNAS 95: 14628-14633 (1998).

Beerli et al., "Positive and Negative Regulation of Endogenous Genes by Designed • Transcription Factors," PNAS 97: 1495-1500 (2000).

Bellefroid et al., "Clustered Organization of Homologous Krab Zinc-Finger Genes With Enhanced Expression in Human T Lymphoid Cells," EMBO J. 12(4): 1363-1374 (1993).

Berg, J.M., "DNA Binding Specificity of Steroid Receptors," Cell 57: 1065-1068 (1989).

Berg, J.M., "SP1 and the Subfamily of Zinc-Finger Proteins With Guanine-Rich Binding Sites," PNAS 89: 11109-11110 (1992).

Berg et al., "The Galvanization of Biology: A Growing Appreciation for the Roles of Zinc," Science 271: 1081-1085 (1996).

Berg, J.M., "Letting Your Fingers do the Walking," Nature Biotechnology 15: 323 (1997).

Bergqvist et al., "Loss of DNA-Binding and New Transcriptiional Trans-Activation Function in Polyomavirus Large T—Antigen With Mutation of Zinc Finger Motif," Nature Biotechnology 18(9): 2715-2720 (1990).

Blaese et al., "Vectors in Cancer Therapy: How Will They Deliver?" Cancer Gene Therapy 2(4): 291- 297 (1995).

Bonde et al., "Ontogeny of the V-ERBA Oncoprotein From the Thyroid Hormone Receptor: an Alteration in the DNA Binding Domain Plays a Role Crucial for Verba Function," J. Virology 65(4): 2037-2046 (1991).

Caponigro et al., "Transdominant Genetic Analysis of a Growth Control Pathway," PNAS 95: 7508-7513 (1998).

Celenza et al., "A Yeast Gene That is Essential for Release From Glucose Repression Encodes a Protein Kinase," Science 233: 1175-1180 (1986).

Cheng et al., "Identification of Potential Target Genes for ADRLP Through Characterization of Essential Nucleotides in UAS1," Mol. Cellular Biol. 14(6): 3842-3852 (1994).

Cheng et al., "A Single Amino Acid Subsitution in Zinc Finger 2 of ADRLP Changes its Binding Specificity at Two Positions in UAS1," J. Mol. Boil. 251: 1-8 (1995).

Choo et al., "Designing DNA-Binding Proteins on the Surface of Filamentous Phage," Curr. Opin. Biotechnology 6: 431-436 (1995).

Choo et al., "Physicial Basis of Protein-DNA Recognition Code," Curr. Opin. Struct. Biol. 7(1): 117-125 (1997).

Choo et al., "Promoter-Specific Activiation of Gene Expression Directed by Bacteriophage-Selected Zinc Fingers," J. Mol. Biol. 273: 525-532 (1997).

Choo et al., "In Vivo Repression by a Site-Specific DNA-Binding Protein Deisned Against an Onogenic Sequence," Nature 372: 642-645 (1994).

Choo et al., "All Wrapped up," Nature Struct. Biol. 5(4): 253-255 (1998).

Choo, Y., "Recognition of DNA Methylation by Zinc Fingers," Nature Struct. Biol. 5(4): 264-265 (1998).

Choo, Y., "End Effects in DNA Recognition Code," Nuc. Acids. Res. 26(2): 554-557 (1998).

Choo et al., "A Role in DNA-Binding for the Linker Sequences of the First Three Zinc Fingers of TFIIIA" Nuc. Acids Res. 21(15): 3341-3346 (1993).

Choo et al., "Toward a Code for the Interactions of Zinc Fingers With DNA: Selection of Randomized Fingers Displayed on Phage," PNAS 91: 11163-11167 (1994).

Choo et al., "Selection of DNA Binding Sites for Zinc Fingers Using Randomized DNAS Reveals Coded Interactions," PNAS 91: 11168-11172 (1994).

Clarke et al., "Zinc Fingers in Caenorhabditis Elegans: Finding Families and Probing Patheways," Science 282: 2018-2022 (1998).

Corbi et al., "Synthesis of a New Zinc Finger Peptide: Comparison of its "Code" Deduced and "Casting" Derived Binding Sites," FEBS Letter 417: 71-74 (1997).

Crozatier et al., "Single Amino Acid Exchanges in Separate Domains of the Drosophilia Serendipity Zinc Finger Protein Cause Embroyonic and Sex Biased Lethality," Genetics 131: 905-916 (1992).

Debs et al., "Regulation of Gene Expression in Vivo by Liposome-Mediated Delivery of a Purified Transcription Factor," J. Biological Chemistry 265(18): 10189-10192 (1990).

DesJardins et al., "Repeated CT Elements Bound by Zinc Finger Proteins Control the Absolute and Relative Activites of the Two Principal Human C-MYC Promoters," Mol. Cell. Biol. 13(9): 5710-5724 (1993).

Desjarlais et al., "Redesigning the DNA-Binding Specificity of a Zinc Finger Protein: a Data Base-Guided Approach," Proteins: Structure, Function, and Genetics 12(2): 101-104 (1992).

Desjarlais et al., "Redesigning the DNA-Binding Specificity of a Zinc Finger Protein: a Data Base-Guided Approach," Proteins: Structure, Function, and Genetics 13(2): 272 (1992).

Desjarlais et al., "Toward Rules Relating Zinc Finger Protein Sequences and DNA Binding Site Preferences," *Proc Natl Acad Sci US A* 89:7345-7349 (1992).

Desjarlais et al., "Use of a Zinc-Finger Consensus Sequences Framework and Specificity Rules to Design Specific DNA Binding, Proteins" PNAS 90: 2256-2260 (1993).

Desjarlais et al., "Length-Encoded Multiplex Binding Site Determination: Application to Zinc Finger Proteins," PNAS 91: 11099-11103 (1994).

Dibello et al., "The Drosophila Broad-Complex Encodes a Family of Related Proteins Containing Zinc Fingers," Genetics 129: 385-397 (1991).

Donze et al., "Activation of Delta-Globin Gene Expression by Erythroid Krupple-Like Factor: a Potential Approach for Gene Therapy of Sickle Cell Disease," Blood 88: 4051-4057 (1996).

Dreier et al., "Insights Into the Molecular Recognition of the 5'-GNN-3' Family of DNA Sequences by Zinc Finger Domains," J. Mol. Biol. 303:489-502 (2000).

Elrod-Erickson et al., "ZIF268 Protein-DNA Complex Refined at 1.6: a Model System for Understanding Zinc Finger-DNA Interactions," Structure 4(10): 1171-1180 (1996).

Elrod-Erickson et al., "High-Resolution Structures of Variant ZIF268-DNA Complexes: Implications for Understanding Zinc Finger-DNA Recognition," Structure 6(4): 451-464 (1998).

Fairall et al., "The Crystal Structure of a Two Zinc-Finger Peptide Reveals an Extension to the Rules for Zinc-Finger/DNA Recognition," Nature 366: 483-487 (1993).

Frankel et al., "Fingering Too Many Proteins," Cell 53: 675 (1988).

Friesen et al., "Phage Display of RNA Binding Zinc Fingers From Transcription Factor IIA," J. Biological Chem. 272(17): 10994-10997 (1997).

Friesen et al., "Specific RNA Binding Proteins Constructed From Zinc Fingers," Nature Structural Biology 5(7): 543-546 (1998).

Ghosh, "A Relational Database of Transcription Factors," Nucleic Acids Res. 18: 1749-1756 (1990).

Gillemans et al., "Altered DNA Binding Specificity Mutants of EKLF and SPL Show That EKLF is an Activator of the B-Globin Locus Control Region in Vivo," Genes and Development 12: 2863-2873 (1998).

Gogos et al., "Recognition of Diverse Sequences by Class I Zinc Fingers: Asymmetries and Indirect Effects on Specificty in the Interaction Between CF2II and A+T-Rich Sequences Elements," PNAS 93(5): 2159-2164 (1996).

Gossen et al.., "Tight Control of Gene Expression in Mammalian Cells by Tetracycline-Responsive Promoter,"PNAS 89:5547-5551 (1992).

Greisman et al., "A General Strategy for Selecting High-Affinity Zinc Finger Proteins for Diverse DNA Target Sites," *Science* 275: 657-661 (1997).

Hall et al., "Functional Interaction Between the Two Zinc Finger Domains of the V-Erba Oncoprotein," Cell Growth & Differentiation 3: 207-216 (1992).

Hamilton et al., "High Affinity Binding Sites for the Wilms'Tumor Suppressor Protein WTI," Nuc. Acids. Res. 23(2): 277-284 (1995).

Hamilton et al., "Comparison of the DNA Binding Characteristics of the Related Zinc Finger Proteins WT1 and EGR1" Biochemistry 37: 2051-2058 (1998).

Hanas et al., "Internal Deletion Mutants of Xenopus Transcription Factor IIIA," Nuc. Acids. Res. 17(23): 9861-9870 (1989).

Hayes et al., "Locations of Contacts Between Individual Zinc Fingers Xenopus Laevis Transcription Factor IIIA and the Internal Control Region of a 5S RNA Gene," Biochemistry 31: 11600-11605 (1992).

Heinzel et al., "A Complex Containing N-CoR, MSin3 and Histone Deacetylese Medates Transcriptional Repression," Nature 387: 43-48 (1997).

Hirst et al., "Discrimination of DNA Response Elements for Thyroid Hormone and Estrogen is Dependent on Dimerization of Receptor DNA Binding Domains," PNAS 89: 5527-5531 (1992).

Hoffman et al., "Structures of DNA-Binding Mutant Zinc Finger Domains: Implications for DNA Binding," Protein Science 2: 951-965 (1993).

Imhof et al., "Transcriptional Regulation of the AP-2ALPHA Promoter by BTEB-1 and AP-2REP, a Novel WT-1/EGR-Related Zinc Finger Repressor," Molecular and Cellular Biology 19(1): 194-204 (1999).

Isalan et al., "Synergy Between Adjacent Zinc Fingers in Sequence-Specific DNA Recognition," PNAS 94(11): 5617-5621 (1997).

Isalan et al., "Comprehensive DNA Recogniition through Concerted Interactions From Adjacent Zinc Fingers," *Biochemistry* 37:12026-12033 (1998).

Jacobs, G. H., "Determination of the Base Recognition Positions of Zinc Fingers From Sequence Analysis," EMBO J. 11(12): 4507-4517 (1992).

Jamieson et al., "A Zinc Finger Directory for High-Affinity DNA Recognition" PNAS 93: 12834-12839 (1996).

Jamieson et al., "In Vitro Selection of Zinc Fingers With Altered DNA-Binding Specificity," *Biochemistry* 33:5689-5695 (1994).

Jones et al., "Replacing the Complementarity-Determining Regions in a Human Antibody With Those From a Mouse," Nature 321: 522-525 (1986).

Julian et al., "Replacement of HIS23 by CYS in a Zinc Finger of HIV-INCP7 LED to a Change in 1H NMR-Derived 3D Structure and to a Loss of Biological Activity," FEBS Letters 331(1,2): 43-48 (1993).

Kamiuchi et al., "New Multi Zinc Finger Protein: Biosynthetic Design and Characteristics of DNA Recognition," Nucleic Acids Symposium Series 37: 153-154 (1997).

Kang et al., "Zinc Finger Proteins as Designer Transcription Factors," *J.Biol Chem* 245(12):8742- 8748 (2000).

Kim et al., "Serine at Position 2 in the DNA Recognition Helix of a CYS2-HIS2 Zinc Finger Peptide is Not, in General, Responsible for Base Recognition," J. Mol. Biol. 252: 1-5 (1995).

Kim et al., "Site-Specific Cleavage of DNA-RNA Hybrids by Zinc Finger/Foki/Cleavage Domain Fusions," Gene 203: 43-49 (1997).

Kim et al., "A 2.2 A° Resolution Crystal Structure of a Designed Zinc Finger Protein Bound to DNA," Nat. Struct. Biol. 3(11): 940-945 (1996).

Kim et al., "Design of TATA Box-Binding Protein/Zinc Finger Fusions for Targeted Regulation of Gene Expression," PNAS 94: 3616-3620 (1997).

Kim et al., "Hybrid Restriction Enzymes: Zinc Finger Fusions FOK 1 Cleavage Domain," PNAS 93: 1156-1160 (1996).

Kim et al., "Transcriptional Repression by Zinc Finger Peptides. Exploring the Potential for Applications in Gene Therapy" J. Biol. Chem. 272: 29795-29800 (1997).

Kim et al., "Getting a Handhold on DNA: Design of Poly-Zinc Finger Proteins With Femtomolar Dissociation Constants," *Proc Natl Acad Sci U S A* 95:2812-2817 (1998).

Kinzler et al., "The GLI Gene is Member of the Kruppel Family of Zinc Finger Proteins," Nature 332: 371-374 (1988).

Klug, A. "Gene Regulatory Proteins and Their Interaction With DNA," Ann. NY Acad. Sci. 758: 143-160 (1995).

Klug et al., "Protein MOTIFS 5: Zinc Fingers," FASEB J. 9: 597-604 (1995).

Klug, "Zinc Finger Peptides for the Regulation of Gene Expression," J. Mol. Biol. 293: 215-218 (1999).

Kothekar, "Computer Simulation of Zinc Finger MOTIF From Cellular Nucleic Acid Binding Proteins and Their Interaction With Consensus DNA Sequences," FEBS Letters 274(1,2): 217-222 (1990).

Kriwacki et al., "Sequence-Specific Recognition of DNA by Zinc Finger Peptides Derived From the Transcription Factors SP-1," PNAS 89: 9759-9763 (1992).

Kudla et al., "The Regulatory Gene Area Mediating Nitrogen Metabolite R in Aspergillus Nidulans Mutations Affecting Specificity of Gene Activation Alter a Loop Residue of Putative Zinc Finger," EMBO J. .9(5): 1355-1364 (1990).

Laird-Offringa et al., "RNA-Binding Proteins Tamed," Nat. Structural Biol. 5(8): 665-668 (1998).

Liu et al., "Design of Polydactyl Zinc-Finger Proteins for Unique Addressing Within Complex Genomes," PNAS 94: 5525-5530 (1997).

Liu et al., "Transcription Factor EGR-1 Suppresses the Growth and Transformation of Human HT-1080 Fibrosarcoma Cells by Induction of Transforming Growth Factor Beta 1," PNAS 93(21): 11831-11836 (1996).

Liu et al., "Regulation of an Endogenous Locus Using a Panel of Designed Zinc Finger Proteins Targeted to Accessible Chromatin Regions," *J Biol Chem* 276:11323-11334 (2001).

Mandel-Gutfreund et al., "Quantitative Parameters for Amino Acid-Base Interaction: Implication for Predication of Protein-DNA Binding Sites," Nuc. Acids Res. 26(10): 2306-2312 (1998).

Margolin et al., "Kruppel-Associated Boxes are Potent Transcriptional Repression Domains," PNAS 91: 4509-4513 (1994).

Mizushima et al., "PEF-BOS, a Powerful Mammilian Expression Vector," Nuc. Acids. Res. 18(17): 5322 (1990).

Mukhopadhyay et al., "The Von Hippel-Lindau Tumor Suppressor Gene Product Interacts With SP1 to Repress Vascular Endothelial Growth Factor Promoter Activity" Mol. Cell. Biol. 17(9): 5629-5639 (1997).

Nakagama et al, "Sequence and Structural Requirements for High-Affinity DNA Binding by the WT1 Gene Product," Molecular and Cellular Biology 15(3): 1489-1498 (1995).

Nardelli et al., "Zinc Finger-DNA Recognition: Analysis of Base Specificity by Site-Directed Mutagenesis," Nucleic Acids Research 20(16): 4137-4144 (1992).

Nardelli et al., "Base Sequence Discrimination by Zinc-Finger DNA-Binding Domains," Nature 349: 175-178 (1991).

Nekludova et al., "Distinctive DNA Conformation With Enlarged Major Groove is Found in ZN-Finger-DNA and Other Protein-DNA Complexes," PNAS 91: 6948-6952 (1994).

Orkin et al., "Report and Recommendations of the Panel to Assess the NIH Investment in Research on Gene Therapy," (Dec. 7, 1995).

Pabo et al., "Systematic Analysis of Possible Hydrogen Bonds Between Amino Acid Side Chains and B-Form DNA," J. Biomolecular Struct. Dynamic 1: 1039-1049 (1983).

Pabo et al., Protein-DNA Recognition, Ann. Rev. Biochem. 53: 293-321 (1984).

Pabo, C.O., "Transcription Factors: Structural Families and Principles of DNA Recognition," Ann. Rev. Biochem. 61: 1053-1095 (1992).

Pavletich et al., "Crystal Structure of a Five-Finger GLI-DNA Complex: New Perspectives on Zinc Fingers," Science, 261: 1701-1707 (1993).

Pavletich et al., "Zinc Finger-DNA Recognition: Crystal Structure of a ZIF268-DNA Complex at 2.1A," Science 252: 809-817 (1991).

Pengue et al., "Repression of Transcriptional Activity at a Distance by the Evolutionarily Conserved Krab Domain Present in a Subfamily of Zinc Finger Proteins," Nuc. Acids Res. 22(15): 2908-2914(1994).

Pengue et al., "Transcriptional Silencing of Human Immunodeficiency Virus Type 1 Long Terminal Repeat-Driven Gene Expression by the Kruppel-Associated Box Repressor Domain Targeted to the Transactivating Response Element," J. Virology 69(10): 6577-6580 (1995).

Pengue et al., "Kruppel-Associated Box-Mediated Repression of RNA Polymerase II Promoters is Influenced by the Arrangement of Basal Promoter Elements," PNAS 93: 1015-1020 (1996).

Pomerantz et al., "Analysis of Homeodomain Fuction by Structure-Based Design of a Transcription Factor," PNAS 92: 9752-9756 (1995).

Pomerantz et al., "Structure-Based Design of a Dimeric Zinc Finger Protein," Biochemistry 37(4): 965-970 (1998).

Pomerantz et al., "Structure-Based Design of Transcription Factors," Science 267: 93-96 (1995).

Qian et al., "Two-Dimensional NMR Studies of the Zinc Finger MOTIF: Solution Structures and Dynamics of Mutant ZFY Domains Containing Aromatic Substitutions in the Hydrophobic Core," Biochemistry 31: 7463-7476 (1992).

Quigley et al., "Complete Androgen Insensitivity Due to Deletion of Exon C of the Androgen Receptor Gene Highlights the Functional Importance of the Second Zinc Finger of the Androgen Receptor in Vivo," Molecular Endocrinology 6(7): 1103-1112 (1992).

Rauscher et al., "Binding of the Wilms' Tumor Locus Zinc Finger Protein to the EGR-I Consensus Sequence," Science 250: 1259-1262 (1990).

Ray et al., "Repressor to Activator Switch by Mutations in the First ZN Finger of the Glucocorticoid Receptor: is Direct DNA Binding Necessary?" PNAS 88: 7086-7090 (1991).

Rebar et al., "Phage Display Methods for Selecting Zinc Finger Proteins With Novel DNA-Binding Specificities," Methods in Enzymology 267: 129-149 (1996).

Rebar et al., "Zinc Finger Phage: Affinity Selection of Fingers With New DNA-Binding Specifities," Science 263: 671-673 (1994).

Reith et al, "Cloning of the Major Histocompatibility Complex Class II Promoter Binding Protein Affected in a Hereditary Defect in Class II Gene Regulation," PNAS 86: 4200-4204 (1989).

Rhodes et al., "Zinc Fingers: They Play a Key Part in Regulating the Activity of Genes in Many Species, From Yeast to Humans, Fewer Than 10 Years Ago No on Knew They Existed." Scientific American 268:56-65 (1993).

Rice et al., "Inhibitors of HIV Nucleocapsid Protein Zinc Fingers as Candidates for the Treatment of AIDS," Science 270: 1194-1197 (1995).

Rivera et al., "A Humanized System for Pharmacologic Control of Gene Expression," Nature Medicine 2(9): 1028-1032 (1996).

Rollins et al., "Role of TFIIIA Zinc Fingers in Vivo: Analysis of Single-Finger Function in Developing Xenopus Embryos," Molecular Cellular Biology 13(8): 4776-4783 (1993).

Sadowski et al., "GAL4-VP16 is an Unusually Potent Transcriptional Activator," Nature 335: 563-568 (1988).

Saleh et al., "A Novel Zinc Finger Gene on Human Chromosome 1 Qter That is Alternatively Spliced in Human Tissues and Cell Lines," American Journal of Human Genetics 52: 192-203 (1993).

Segal et al., "Toward Controlling Gene Expression at Will:Selection and Design of Zinc Finger Domains Recognizing Each of the 5'-GNN-3' DNA Target Sequences ," PNAS USA 96:2758-2763 (1999).

Shi et al., "Specific DNA-RNA Hybrid Binding by Zinc Finger Proteins," Science 268: 282-284 (1995).

Shi et al., "DNA Unwinding Induced by Zinc Finger Protein Binding," Biochemistry 35: 3845-3848 (1996).

Shi et al., "A Direct Comparison of the Properties of Natural and Designed Finger Proteins," Chem. & Biol. 2(2): 83-89 (1995).

Singh et al., "Molecular Cloning of an Enhancer Binding Protein: Isolation by Screening of an Expression Library With a Recognition Site DNA," Cell 52: 415-423 (1988).

Skerka et al., "Coordinate Expression and Distinct DNA-Binding Characteristics of the Four EGR-Zinc Finger Proteins in Jurkat T Lymphocytes," Immunobiology 198: 179-191 (1997).

South et al., "The Nucleocapsid Protein Isolated From HIV-1 Particles Binds Zinc and Forms Retroviral-Type Zinc Fingers," Biochemistry 29: 7786-7789 (1990).

Spengler et al., "Regulation of Apoptosis and Cell Cycle Arrest by ZZC1, a Novel Zinc Finger Protein Expressed in the Pituitary Gland and the Brain," EMBO J. 16(10): 2814-2825 (1997).

Suzuki et al., "Stereochemical Basis of DNA Recognition by ZN Fingers," Nuc. Acids Res. 22(16): 3397-3405 (1994).

Suzuki et al., "DNA Recognition Code of Transcriptional Factors in the Helix-Turn-Helix, Probe Helix, Hormone Receptor, and Zinc Finger Families," PNAS 91: 12357-12361 (1994).

Swimoff et al, "DNA-Binding Specificity of NGFI-A and Related Zinc Finger Transcriptional Factors," Mol. Cell. Biol. 15(14): 2275-2287 (1995).

Taylor et al., "Designing Zinc-Finger ADRI Mutants With Altered Specificity of DNA Binding to T in UASI Sequences," Biochemistry 34: 3222-3230 (1995).

Thiesen et al., "Amino Acid Substitutions in the SPI Zinc Finger Domain Alter the DNA Binding Affinity to Cognate SPI Target Site ," Biochem. Biophys. Res. Communications 175(1): 333-338 (1991).

Thiesen et al., "Determination of DNA Binding Specificities of Mutated Zinc Finger Domains," FEBS letters 283(1): 23-26 (1991).

Thiesen H. J. "From Repression Domains to Designer Zinc Finger Proteins: a Novel Strategy for Intracellular Immunization Against HIV," Gene Expression 5:229-243 (1996).

Thukral et al., "Localization of a Minimal Binding Domain and Activation Regions in Yeast Regulatory Protein ADRI1," Molecular Cellular Biology 9(6): 2360-2369 (1989).

Thukral et al., "Two Monomers of Yeast Transcription Factor ADR1 Bind a Paldromic Sequence Symmetrically to Activate ADH2 Expression," Molecular Cellular Biol. 11(3): 1566-1577 (1991).

Thukral et al., "Mutations in the Zinc Fingers of ADR1 That Change the Specificity of DNA Binding and Transactivation," Mol. Cell. Biol. 12(6): 2784-2792 (1992).

Thukral et al., "Alanine Scanning Site-Directed Mutagenesis of the Zinc Fingers of Transcription Factor ADR1: Residues That Contact DNA and That Transactivate," PNAS 88: 9188-9192 (1991).

Vortkamp et al., "Identification of Optimized Target Sequences for the GL 13 Zinc Finger Protein," DNA Cell Biol. 14(7): 629-634 (1995).

Wang et al., "Dimerization of Zinc Fingers Mediated by Peptides Evolved in Vitro From Random Sequences," PNAS 96: 9568-9573 (1999).

Webster et al., "Conversion of the EIA CYS4 Zinc Finger to a Nanfunctional HIS2, CYS2 Zinc Finger by a Single Point Mutation," PNAS 88: 9989-9993 (1999).

Whyatt et al., "The Two Zinc Finger-Like Domains of GATA-1 Have Different DNA Binding Specificities," EMBO J. 12(13): 4993-5005 (1993).

Wilson et al., "In Vivo Mutational Analysis of the NGFI-A Zinc Fingers" J. Biol. Chem. 267(6): 3718-3724 (1992).

Witzgall et al., "The Kruppel-Associated Box-A (KRAB-A) Domain of Zinc Finger Proteins Mediates Transcriptional Repression," PNAS 91: 4514-4518 (1994).

Wolfe et al., "Analysis of Zinc Fingers Optimized Via Phage Display: Evaluating the Utility of a Recognition Code," J. Mol. Biol. 285: 1917-1934 (1999).

Wright et al., "Expression of a Zinc Finger Gene in HTLV-I and HTLV-II Transformed Cell," Science 248:588-591 (1990).

Wu et al., "Human Immunodeficiency Virus Type 1 Nucleocapsid Protein Reduces Reverse Transcriptase Pausing at a Secondary Structure Near the Murine Leukemia Virus Polypurine Tract," J. Virol. 70(10): 7132-7142 (1996).

Wu et al., "Building Zinc Fingers by Selection: Toward a Therapeutic Application," PNAS 92: 344-348 (1995).

Yang et al., "Surface Plasmon Resonance Based Kinetic Studies of Zinc Finger-DNA Interaction," J. Immunol. Methods 183: 175-182 (1995).

Yu et al., "A Hairpin Ribozyme Inhibits Expression of Diverse Strains of Human Immunodeficiency Virus Type 1," PNAS 90: 6340-6344 (1993).

Zhang et al., "Synthetic Zinc Finger Transcription Factor Action at an Endogenous Chromosomal Site. Activation of the Human Erythropoietin Gene," Journal of Biological Chemistry 275(43): 33850-33860 (2000).

Search of Swissprot. Data Base Performed CA Aug. 2000.

* cited by examiner

Figure 1

| ZFP1 | F3: RSDNLAR | | | F2: RSDELRT | | | F1: DRSNLTR | | | Target | | $K_d$ (nM) |
|---|---|---|---|---|---|---|---|---|---|---|---|---|
| Target | G | A | G | T | C | G | G | A | C | Cognate | GAGTCGGAC | 50 |
| Selected | G14 | A12 | G11 | G10 | T6 | G11 | G12 | A10 | C11 | Mt-1 | GAGGTGGAC | 12.5 |
| | | G2 | C2 | T3 | C4 | T1 | T1 | G2 | G2 | Mt-2 | GAGTCGGAG | > 400 |
| | | | T1 | C1 | G4 | A1 | C1 | T1 | A1 | | | |
| | | | | | | C1 | | C1 | | | | |

| ZFP2 | F3: RSDHLSR | | | F2: QSSHLAR | | | F1: QSSDLRR | | | Target | | $K_d$ (nM) |
|---|---|---|---|---|---|---|---|---|---|---|---|---|
| Target | G | G | G | G | G | T | G | C | T | Cognate | GGGGGTGCT | 1 |
| Selected | G11 | G7 | G11 | G12 | G10 | A5 | G10 | C12 | T6 | Mt-3 | GGGGGAGCT | 0.5 |
| | T1 | T3 | T1 | | A2 | T3 | T1 | C2 | C2 | Mt-4 | GGGGGCGCT | 1 |
| | | A2 | | | | C3 | C1 | | G2 | | | |
| | | | | | | G1 | | | A2 | | | |

Figure 2

| | | | | | | | | |
|---|---|---|---|---|---|---|---|---|
| GAG | F1: RSDNLAR | F2: RSDNLAR | F3: RSDNLTR | GAT | F1: QSSNLAR | F2: TSGNLVR | F3: TSANLSR |
| 5'-3' | G A G | G A G | G A G | 5'-3' | G A T | G A T | G A T |
| | G22 A22 G21<br>A1 | G24 A23 G24<br>T1 | G16 A15 G16<br>G1 | | G14 A10 T9<br>G2 G2<br>C2 A2<br>C1 | G14 A12 T12<br>G1 G2<br>T1 | G18 A18 T18 |
| GGG | F1: RSDHLAR | F2: RSDHLSR | F3: RSDHLSR | GAC | F1: DRSNLTR | F2: DRSNLTR | F3: DRSNLTR |
| 5'-3' | G G G | G G G | G G G | 5'-3' | G A C | G A C | G A C |
| | G14 G11 G12<br>A2 A1<br>C1 C1 | G19 G11 G19<br>A6<br>C1<br>T1 | G15 G14 G14<br>T1 C1 | | G12 A10 C11<br>T1 G2 G2<br>C1 T1 A1<br>C1 | G15 A15 C12<br>T2<br>G1 | G16 A11 C11<br>T2 C4 A6<br>C1 G3 G1<br>T1 T1 |
| GTG | F1: RSDALTR | F2: RSDALSR | F3: RSDALTR | GGA | F1: QSGHLAR | F2: QSGHLQR | F3: QSGHLQR |
| 5'-3' | G T G | G T G | G T G | 5'-3' | G G A | G G A | G G A |
| | G15 T14 G15<br>G1 | G15 T12 G15<br>G2<br>A1 | G14 T13 G12<br>G1 T2 | | G15 G15 A10<br>G3<br>T2 | G17 G13 A13<br>A2 G3<br>C2 T1 | G14 G14 A14 |
| GCG | F1: RSDDLTR | F2: RSDDLQR | F3: RSDDLTR | GGT | F1: QSSHLTR | F2: TSGHLSR | F3: TSGHLVR |
| 5'-3' | G C G | G C G | G C G | 5'-3' | G G T | G G T | G G T |
| | G13 C11 G14<br>T1 T3 | G21 C18 G21<br>G2<br>T1 | G18 C16 G16<br>G2 T1<br>C1 | | G17 G16 T12<br>A1 C4<br>A1 | G17 G14 T16<br>A2 G1<br>C1 | G16 G15 T14<br>T1 T2 G4<br>C1 A1 |
| GCA | F1: QSGSLTR | F2: QSGDLTR | F3: QSGDLTR | GGC | F1: DRSHLTR | F2: DRSHLAR | F3: DRSHLAR |
| 5'-3' | G C A | G C A | G C A | 5'-3' | G G C | G G C | G G C |
| | G17 C12 A12<br>G3 T2<br>T2 G2<br>C1 | G19 C18 A18<br>G1 C1 | G7 C7 A6<br>A2 G1 T3<br>T1 | | G15 G12 C9<br>A2 T4<br>T1 G2 | G13 G10 C7<br>A3 T3<br>A2<br>C1 | G13 G14 T6<br>A1 T1 C3<br>A3<br>G3 |
| GCT | F1: QSSDLTR | F2: QSSDLTR | F3: QSSDLQR | GTA | F1: QSGALTR | F2: QSGALAR | F3: QRASLTR |
| 5'-3' | G C T | G C T | G C T | 5'-3' | G T A | G T A | G T A |
| | G19 C19 T16<br>G3 | G15 C15 T15 | G10 C17 T10<br>A9 T1 G7<br>G1 A2 | | G11 T7 A7<br>A2 G2<br>G1 T2<br>C1 | G10 T6 A9<br>A3 G1<br>G1 | G5 G4 A5<br>A4 T3 G3<br>A1 T1<br>C1 |
| GCC | F1: ERGTLAR | F2: DRSDLTR | F3: DRSDLTR | GTT | F1: TTSALTR | F2: TSGALTR | F3: QSSALTR |
| 5'-3' | G C C | G C C | G C C | 5'-3' | G T T | G T T | G T T |
| | G19 C12 C11<br>T4 G3<br>A3 C3<br>T2 | G20 C20 C13<br>T7 | G17 C13 C13<br>A1 A2 T3<br>G2 A2<br>T1 | | G21 T16 G8<br>G3 T6<br>A1 C4<br>C1 A3 | G9 T8 G5<br>A1 T4 | G5 T2 T3<br>A1 G2 A3<br>A1<br>C1 |
| GAA | F1: QRSNLVR | F2: QSGNLAR | F3: QSGNLAR | GTC | F1: DRSALAR | F2: DRSALAR | F3: DRSALAR |
| 5'-3' | G A A | G A A | G A A | 5'-3' | G T C | G T C | G T C |
| | G19 A19 A10<br>T6<br>G3 | G11 A10 A10<br>T1 G1 | G8 A8 A6<br>A1 G1 G3 | | G14 T7 C9<br>A5 T2<br>G2 A2<br>G1 | G15 T11 C9<br>T1 A3 T6<br>G1 A1<br>C1 | G13 T7 C6<br>G5 G6<br>C1 T1 |

| Design | F1: QSGDLTR | | | F2: QSGDLTR | | | F3: QSGDLTR | | |
|---|---|---|---|---|---|---|---|---|---|
| Target | G | C | A | G | C | A | G | C | A |
| 5'-3' | G19 | C16 | T13 | G19 | C18 | A18 | G7 | C7 | A6 |
|  | G2 | G2 |  |  | G1 | C1 | A2 | G1 | T3 |
|  | T1 | A2 |  |  |  |  |  |  | T1 |
|  |  | C2 |  |  |  |  |  |  |  |

B

| Design | F1: QSSNLAR | | | F2: QSSNLAR | | | F3: QQSNLAR | | |
|---|---|---|---|---|---|---|---|---|---|
| Target | G | A | T | G | A | T | G | A | T |
| 5'-3' | G14 | A10 | T9 | G17 | A17 | A10 | G21 | A18 | A11 |
|  | G2 | G2 |  |  |  | T5 |  | G2 | T9 |
|  | C2 | A2 |  |  |  | G2 |  | C1 | G1 |
|  |  | C1 |  |  |  |  |  |  |  |
| Design | F1: TSGNLVR | | | F2: TSGNLVR | | | F3: TSANLSR | | |
| Target | G | A | T | G | A | T | G | A | T |
| 5'-3' | G7 | A5 | T4 | G14 | A12 | T12 | G18 | A18 | T18 |
|  | A3 | C4 | G3 |  | G1 | G2 |  |  |  |
|  | T1 | T2 | C1 |  |  | T1 |  |  |  |
|  | C1 |  |  |  |  |  |  |  |  |

C

| Design | F1: QSSHLTR | | | F2: QSSHLAR | | | F3: QSSHLAR | | |
|---|---|---|---|---|---|---|---|---|---|
| Target | G | G | T | G | G | T | G | G | T |
| 5'-3' | G17 | G16 | T12 | G18 | G18 | A16 | G13 | G13 | A7 |
|  | A1 | C4 |  |  |  | T2 | A2 | A1 | T4 |
|  |  | A1 |  |  |  |  |  | T1 | G4 |
| Design | F1: TSGHLVR | | | F2: TSGHLVR | | | F3: TSGHLVR | | |
| Target | G | G | T | G | G | T | G | G | T |
| 5'-3' | G18 | G13 | A9 | G17 | G17 | T16 | G16 | G15 | T14 |
|  | T2 | T4 | T5 |  |  | C1 | T1 | T2 | G4 |
|  |  | A2 | C5 |  |  |  | C1 | A1 |  |
|  |  | C1 | G1 |  |  |  |  |  |  |

POSITION DEPENDENT RECOGNITION OF GNN NUCLEOTIDE TRIPLETS BY ZINC FINGERS

CROSS-REFERENCES TO RELATED APPLICATIONS

The present application is a continuation of U.S. patent application Ser. No. 09/989,994 filed Nov. 20, 2001 now abandoned which is a continuation-in-part of U.S. patent application Ser. No. 09/535,088 filed Mar. 23, 2000, now abandoned, which application claims the benefit of U.S. provisional applications 60/126,238, filed Mar. 24, 1999, 60/126, 239 filed Mar. 24, 1999, 60/146,595 filed Jul. 30, 1999 and 60/146,615 filed Jul. 30, 1999. U.S. patent application Ser. No. 09/989,994 filed Nov. 20, 2001 is also a continuation-in-part of U.S. patent application Ser. No. 09/716,637, filed Nov. 20, 2000, now U.S. Pat. No. 6,794,136. The disclosures of all of the aforementioned applications are hereby incorporated by reference in their entireties for all purposes.

SEQUENCE LISTING

Reference is made to the 947 page sequence listing which accompanies this patent application on compact disc form of 1.68 MB, submitted herewith in duplicate, entitled "Sequence Listing" and created on Sep. 22, 2005, which is herein incorporated by reference.

BACKGROUND

Zinc finger proteins (ZFPs) are proteins that can bind to DNA in a sequence-specific manner. Zinc fingers were first identified in the transcription factor TFIIIA from the oocytes of the African clawed toad, Xenopus laevis. An exemplary motif characterizing one class of these protein ($C_2H_2$ class) is -Cys-$(X)_{2-4}$-Cys-$(X)_{12}$-His-$(X)_{3-5}$-His (where X is any amino acid) (SEQ. ID. No:1). A single finger domain is about 30 amino acids in length, and several structural studies have demonstrated that it contains an alpha helix containing the two invariant histidine residues and two invariant cysteine residues in a beta turn co-ordinated through zinc. To date, over 10,000 zinc finger sequences have been identified in several thousand known or putative transcription factors. Zinc finger domains are involved not only in DNA-recognition, but also in RNA binding and in protein-protein binding. Current estimates are that this class of molecules will constitute about 2% of all human genes.

The x-ray crystal structure of Zif268, a three-finger domain from a murine transcription factor, has been solved in complex with a cognate DNA sequence and shows that each finger can be superimposed on the next by a periodic rotation. The structure suggests that each finger interacts independently with DNA over 3 base-pair intervals, with side-chains at positions −1, 2, 3 and 6 on each recognition helix making contacts with their respective DNA triplet subsites. The amino terminus of Zif268 is situated at the 3' end of the DNA strand with which it makes most contacts. Some zinc fingers can bind to a fourth base in a target segment. If the strand with which a zinc finger protein makes most contacts is designated the target strand, some zinc finger proteins bind to a three base triplet in the target strand and a fourth base on the nontarget strand. The fourth base is complementary to the base immediately 3' of the three base subsite.

The structure of the Zif268-DNA complex also suggested that the DNA sequence specificity of a zinc finger protein might be altered by making amino acid substitutions at the four helix positions (−1, 2, 3 and 6) on each of the zinc finger recognition helices. Phage display experiments using zinc finger combinatorial libraries to test this observation were published in a series of papers in 1994 (Rebar et al., Science 263, 671-673 (1994); Jamieson et al., Biochemistry 33, 5689-5695 (1994); Choo et al, PNAS 91, 11163-11167 (1994)). Combinatorial libraries were constructed with randomized side-chains in either the first or middle finger of Zif268 and then used to select for an altered Zif268 binding site in which the appropriate DNA sub-site was replaced by an altered DNA triplet. Further, correlation between the nature of introduced mutations and the resulting alteration in binding specificity gave rise to a partial set of substitution rules for design of ZFPs with altered binding specificity.

Greisman & Pabo, Science 275, 657-661 (1997) discuss an elaboration of the phage display method in which each finger of a Zif268 was successively randomized and selected for binding to a new triplet sequence. This paper reported selection of ZFPs for a nuclear hormone response element, a p53 target site and a TATA box sequence.

A number of papers have reported attempts to produce ZFPs to modulate particular target sites. For example, Choo et al., Nature 372, 645 (1994), report an attempt to design a ZFP that would repress expression of a bcr-abl oncogene. The target segment to which the ZFPs would bind was a nine base sequence 5'GCA GAA GCC3' chosen to overlap the junction created by a specific oncogenic translocation fusing the genes encoding bcr and abl. The intention was that a ZFP specific to this target site would bind to the oncogene without binding to abl or bcr component genes. The authors used phage display to screen a mini-library of variant ZFPs for binding to this target segment. A variant ZFP thus isolated was then reported to repress expression of a stably transfected bcr-able construct in a cell line.

Pomerantz et al., Science 267, 93-96 (1995) reported an attempt to design a novel DNA binding protein by fusing two fingers from Zif268 with a homeodomain from Oct-1. The hybrid protein was then fused with a transcriptional activator for expression as a chimeric protein. The chimeric protein was reported to bind a target site representing a hybrid of the subsites of its two components. The authors then constructed a reporter vector containing a luciferase gene operably linked to a promoter and a hybrid site for the chimeric DNA binding protein in proximity to the promoter. The authors reported that their chimeric DNA binding protein could activate expression of the luciferase gene.

Liu et al., PNAS 94, 5525-5530 (1997) report forming a composite zinc finger protein by using a peptide spacer to link two component zinc finger proteins each having three fingers. The composite protein was then further linked to transcriptional activation domain. It was reported that the resulting chimeric protein bound to a target site formed from the target segments bound by the two component zinc finger proteins. It was further reported that the chimeric zinc finger protein could activate transcription of a reporter gene when its target site was inserted into a reporter plasmid in proximity to a promoter operably linked to the reporter.

Choo et al., WO 98/53058, WO98/53059, and WO 98/53060 (1998) discuss selection of zinc finger proteins to bind to a target site within the HIV Tat gene. Choo et al. also discuss selection of a zinc finger protein to bind to a target site encompassing a site of a common mutation in the oncogene ras. The target site within ras was thus constrained by the position of the mutation.

Previously-disclosed methods for the design of sequence-specific zinc finger proteins have often been based on modularity of individual zinc fingers; i.e., the ability of a zinc finger to recognize the same target subsite regardless of the location of the finger in a multi-finger protein. Although, in many instances, a zinc finger retains the same sequence specificity regardless of its location within a multi-finger protein; in certain cases, the sequence specificity of a zinc finger depends on its position. For example, it is possible for a finger to recognize a particular triplet sequence when it is present as finger 1 of a three-finger protein, but to recognize a different triplet sequence when present as finger 2 of a three-finger protein.

Attempts to address situations in which a zinc finger behaves in a non-modular fashion (i.e., its sequence specificity depends upon its location in a multi-finger protein) have, to date, involved strategies employing randomization of key binding residues in multiple adjacent zinc fingers, followed by selection. See, for example, Isalan et al. (2001) *Nature Biotechnol.* 19:656-660. However, methods for rational design of polypeptides containing non-modular zinc fingers have not heretofore been described.

SUMMARY

The present disclosure provides compositions comprising and methods involving position dependent recognition of GNN nucleotide triplets by zinc fingers.

Thus, provided herein is a zinc finger protein that binds to a target site, said zinc finger protein comprising a first (F1), a second (F2), and a third (F3) zinc finger, ordered F1, F2, F3 from N-terminus to C-terminus, said target site comprising, in 3' to 5' direction, a first (S1), a second (S2), and a third (S3) target subsite, each target subsite having the nucleotide sequence GNN, wherein if S1 comprises GAA, F1 comprises the amino acid sequence QRSNLVR (SEQ ID NO:158); if S2 comprises GAA, F2 comprises the amino acid sequence QSGNLAR (SEQ ID NO:801); if S3 comprises GAA, F3 comprises the amino acid sequence QSGNLAR (SEQ ID NO:801); if S1 comprises GAG, F1 comprises the amino acid sequence RSDNLAR (SEQ ID NO:130); if S2 comprises GAG, F2 comprises the amino acid sequence RSDNLAR (SEQ ID NO:130); if S3 comprises GAG, F3 comprises the amino acid sequence RSDNLTR (SEQ ID NO:231); if S1 comprises GAC, F1 comprises the amino acid sequence DRSNLTR (SEQ ID NO:395); if S2 comprises GAC, F2 comprises the amino acid sequence DRSNLTR (SEQ ID NO:395); if S3 comprises GAC, F3 comprises the amino acid sequence DRSNLTR (SEQ ID NO:395); if S1 comprises GAT, F1 comprises the amino acid sequence QSSNLAR (SEQ ID NO:1765); if S2 comprises GAT, F2 comprises the amino acid sequence TSGNLVR (SEQ ID NO:1442); if S3 comprises GAT, F3 comprises the amino acid sequence TSANLSR (SEQ ID NO:377); if S1 comprises GGA, F1 comprises the amino acid sequence QSGHLAR (SEQ ID NO:413); if S2 comprises GGA, F2 comprises the amino acid sequence QSGHLQR (SEQ ID NO:287); if S3 comprises GGA, F3 comprises the amino acid sequence QSGHLQR (SEQ ID NO:287); if S1 comprises GGG, F1 comprises the amino acid sequence RSDHLAR (SEQ ID NO:127); if S2 comprises GGG, F2 comprises the amino acid sequence RSDHLSR (SEQ ID NO:229); if S3 comprises GGG, F3 comprises the amino acid sequence RSDHLSR (SEQ ID NO:229); if S1 comprises GGC, F1 comprises the amino acid sequence DRSHLTR (SEQ ID NO:1506); if S2 comprises GGC, F2 comprises the amino acid sequence DRSHLAR (SEQ ID NO:1092); if S1 comprises GGT, F1 comprises the amino acid sequence QSSHLTR (SEQ ID NO:835); if S2 comprises GGT, F2 comprises the amino acid sequence TSGHLSR (SEQ ID NO:1201); if S3 comprises GGT, F3 comprises the amino acid sequence TSGHLVR (SEQ ID NO:1425); if S1 comprises GCA, F1 comprises the amino acid sequence QSGSLTR (SEQ ID NO:342); if S2 comprises GCA, F2 comprises QSGDLTR (SEQ ID NO:220); if S3 comprises GCA, F3 comprises QSGDLTR (SEQ ID NO:220); if S1 comprises GCG, F1 comprises the amino acid sequence RSDDLTR (SEQ ID NO:188); if S2 comprises GCG, F2 comprises the amino acid sequence RSDDLQR (SEQ ID NO:1844); if S3 comprises GCG, F3 comprises the amino acid sequence RSDDLTR (SEQ ID NO:188); if S1 comprises GCC, F1 comprises the amino acid sequence ERGTLAR (SEQ ID NO:131); if S2 comprises GCC, F2 comprises the amino acid sequence DRSDLTR (SEQ ID NO:417); if S3 comprises GCC, F3 comprises the amino acid sequence DRSDLTR (SEQ ID NO:417); if S1 comprises GCT, F1 comprises the amino acid sequence QSSDLTR (SEQ ID NO:1450); if S2 comprises GCT, F2 comprises the amino acid sequence QSSDLTR (SEQ ID NO:1450); if S3 comprises GCT, F3 comprises the amino acid sequence QSSDLQR (SEQ ID NO:132); if S1 comprises GTA, F1 comprises the amino acid sequence QSGALTR (SEQ ID NO:1398); if S2 comprises GTA, F2 comprises the amino acid sequence QSGALAR (SEQ ID NO:3339); if S1 comprises GTG, F1 comprises the amino acid sequence RSDALTR (SEQ ID NO:153); if S2 comprises GTG, F2 comprises the amino acid sequence RSDALSR (SEQ ID NO:237); if S3 comprises GTG, F3 comprises the amino acid sequence RSDALTR (SEQ ID NO:153); if S1 comprises GTC, F1 comprises the amino acid sequence DRSALAR (SEQ ID NO:184); if S2 comprises GTC, F2 comprises the amino acid sequence DRSALAR (SEQ ID NO:184); and if S3 comprises GTC, F3 comprises the amino acid sequence DRSALAR (SEQ ID NO:184).

Also provided are methods of designing a zinc finger protein comprising a first (F1), a second (F2), and a third (F3) zinc finger, ordered F1, F2, F3 from N-terminus to C-terminus that binds to a target site comprising, in 3' to 5' direction, a first (S1), a second (S2), and a third (S3) target subsite, each target subsite having the nucleotide sequence GNN, the method comprising the steps of (a) selecting the F1 zinc finger such that it binds to the S1 target subsite, wherein if S1 comprises GAA, F1 comprises the amino acid sequence QRSNLVR (SEQ ID NO:158); if S1 comprises GAG, F1 comprises the amino acid sequence RSDNLAR (SEQ ID NO:130); if S1 comprises GAC, F1 comprises the amino acid sequence DRSNLTR (SEQ ID NO:395); if S1 comprises GAT, F1 comprises the amino acid sequence QSSNLAR (SEQ ID NO:1765); if S1 comprises GGA, F1 comprises the amino acid sequence QSGHLAR (SEQ ID NO:413); if S1 comprises GGG, F1 comprises the amino acid sequence RSDHLAR (SEQ ID NO:127); if S1 comprises GGC, F1 comprises the amino acid sequence DRSHLRT (SEQ ID NO:1506); if S1 comprises GGT, F1 comprises the amino acid sequence QSSHLTR (SEQ ID NO:835); if S1 comprises GCA, F1 comprises QSGSLTR (SEQ ID NO:342); if S1 comprises GCG, F1 comprises RSDDLTR (SEQ ID NO:188); if S2 comprises GCG, F2 comprises RSDDLQR (SEQ ID NO:1844); if S1 comprises GCC, F1 comprises ERGTLAR (SEQ ID NO:131); if S1 comprises GCT, F1 comprises the amino acid sequence QSSDLTR (SEQ ID NO:1450); if S1 comprises GTA, F1 comprises the amino acid sequence QSGALTR (SEQ ID NO:1398); if S1 comprises GTG, F1 comprises the amino acid sequence RSDALTR (SEQ ID NO:153); if S1 comprises GTC, F1 comprises the amino acid sequence DRSALAR (SEQ ID NO:184); (b) selecting the F2 zinc finger such that it binds to the S2 target subsite, wherein S2 comprises GAA, F2 comprises the amino acid sequence QSGNLAR (SEQ ID NO:801); if S2 comprises GAG, F2 comprises the amino acid sequence RSDNLAR (SEQ ID NO:130); if S2 comprises GAC, F2 comprises the amino acid sequence DRSNLTR (SEQ ID NO:395); if S2 comprises GAT, F2 comprises the amino acid sequence TSGNLVR (SEQ ID NO:1442); if S2 comprises GGA, F2 comprises the amino acid sequence QSGHLQR (SEQ ID NO:287); if S2 comprises GGG, F2 comprises the amino acid sequence RSDHLSR (SEQ ID NO:229); if S2 comprises GGC, F2 comprises the amino acid sequence DRSHLAR (SEQ ID NO:1092); if S2 comprises GGT, F2 comprises the amino acid sequence TSGHLSR (SEQ ID NO:1201); if S2 comprises GCA, F2 comprises the amino acid sequence QSGDLTR (SEQ ID NO:220); if S2 comprises GCC, F2 comprises the amino acid sequence DRSDLTR (SEQ ID NO:417); if S2 comprises GCT, F2 comprises the amino acid sequence QSSDLTR (SEQ ID NO:1450); if S2 comprises GTA, F2 comprises the amino acid sequence QSGALAR (SEQ ID NO:3339); if S2 comprises GTG, F2 comprises the amino acid sequence RSDALSR (SEQ ID NO:237); if S2 comprises GTC, F2 comprises the amino acid sequence DRSALAR (SEQ ID NO:184); and (c) selecting the F3 zinc finger such that it binds to the S3 target subsite, wherein if S3 comprises GAA, F3 comprises the amino acid sequence QSGNLAR (SEQ ID NO:801); if S3 comprises GAG, F3 comprises the amino acid sequence RSDNLTR (SEQ ID NO:231); if S3 comprises GAC, F3 comprises the amino acid sequence DRSNLTR (SEQ ID NO:395); if S3 comprises GAT, F3 comprises the amino acid sequence TSANLSR (SEQ ID NO:377); if S3 comprises GGA, F3 comprises the amino acid sequence QSGHLQR (SEQ ID NO:287); if S3 comprises GGG, F3 comprises the amino acid sequence RSDHLSR (SEQ ID NO:229); if S3 comprises GGT, F3 comprises the amino acid sequence TSGHLVR (SEQ ID NO:1425); if S3 comprises GCA, F3 comprises the amino acid sequence QSGDLTR (SEQ ID NO:220); if S3 comprises GCG, F3 comprises the amino acid sequence RSDDLTR (SEQ ID NO:188); if S3 comprises GCC, F3 comprises the amino acid sequence DRSDLTR (SEQ ID NO:417); if S3 comprises GCT, F3 comprises the amino acid sequence QSSDLQR (SEQ ID NO:132); if S3 comprises GTG, F3 comprises RSDALTR (SEQ ID NO:153); and if S3 comprises GTC, F3 comprises the amino acid sequence DRSALAR (SEQ ID NO:184);

thereby designing a zinc finger protein that binds to a target site.

In certain embodiments of the zinc finger proteins and methods described herein, S1 comprises GAA and F1 comprises the amino acid sequence QRSNLVR (SEQ ID NO:158). In other embodiments, S2 comprises GAA and F2 comprises the amino acid sequence QSGNLAR (SEQ ID NO:801). In other embodiments, S3 comprises GAA and F3 comprises the amino acid sequence QSGNLAR (SEQ ID NO:801). In other embodiments, S1 comprises GAG and F1 comprises the amino acid sequence RSDNLAR (SEQ ID NO:130). In other embodiments, S2 comprises GAG and F2 comprises the amino acid sequence RSDNLAR (SEQ ID NO:130). In other embodiments, S3 comprises GAG and F3 comprises the amino acid sequence RSDNLTR (SEQ ID NO:231). In other embodiments, S1 comprises GAC and F1 comprises the amino acid sequence DRSNLTR (SEQ ID NO:395). In other embodiments, S2 comprises GAC and F2 comprises the amino acid sequence DRSNLTR (SEQ ID NO:395). In other embodiments, S3 comprises GAC and F3 comprises the amino acid sequence DRSNLTR (SEQ ID NO:395). In other embodiments, S1 comprises GAT and F1 comprises the amino acid sequence QSSNLAR (SEQ ID NO:1765). In other embodiments, S2 comprises GAT and F2 comprises the amino acid sequence TSGNLVR (SEQ ID NO:1442). In other embodiments, S3 comprises GAT and F3 comprises the amino acid sequence TSANLSR (SEQ ID NO:377). In other embodiments, S1 comprises GGA and F1 comprises the amino acid sequence QSGHLAR (SEQ ID NO:413). In other embodiments, S2 comprises GGA and F2 comprises the amino acid sequence QSGHLQR (SEQ ID NO:287). In other embodiments, S3 comprises GGA and F3 comprises the amino acid sequence QSGHLQR (SEQ ID NO:287). In other embodiments, S1 comprises GGG and F1 comprises the amino acid sequence RSDHLAR (SEQ ID NO:127). In other embodiments, S2 comprises GGG and F2 comprises the amino acid sequence RSDHLSR (SEQ ID NO:229). In other embodiments, S3 comprises GGG and F3 comprises the amino acid sequence RSDHLSR (SEQ ID NO:229). In other embodiments, S1 comprises GGC and F1 comprises the amino acid sequence DRSHLTR (SEQ ID NO:705). In other embodiments, S2 comprises GGC and F2 comprises the amino acid sequence DRSHLAR (SEQ ID NO:1092). In other embodiments, S1 comprises GGT and F1 comprises the amino acid sequence QSSHLTR (SEQ ID NO:835). In other embodiments, S2 comprises GGT and F2 comprises the amino acid sequence TSGHLSR (SEQ ID NO:1201). In other embodiments, S3 comprises GGT and F3 comprises the amino acid sequence TSGHLVR (SEQ ID NO:1425). In other embodiments, S1 comprises GCA and F1 comprises the amino acid sequence QSGSLTR (SEQ ID NO:342). In other embodiments, S2 comprises GCA and F2 comprises the amino acid sequence QSGDLTR (SEQ ID NO:220). In other embodiments, S3 comprises GCA and F3 comprises the amino acid sequence QSGDLTR (SEQ ID NO:220). In other embodiments, S1 comprises GCG and F1 comprises the amino acid sequence RSDDLTR (SEQ ID NO:188). In other embodiments, S2 comprises GCG and F2 comprises the amino acid sequence RSDDLQR (SEQ ID NO:1844). In other embodiments, S3 comprises GCG and F3 comprises the amino acid sequence RSDDLTR (SEQ ID NO:188). In other embodiments, S1 comprises GCC and F1 comprises the amino acid sequence ERGTLAR (SEQ ID NO:131). In other embodiments, S2 comprises GCC and F2 comprises the amino acid sequence DRSDLTR (SEQ ID NO:417). In other embodiments, S3 comprises GCC and F3 comprises the amino acid sequence DRSDLTR (SEQ ID NO:417). In other embodiments, S1 comprises GCT and F1 comprises the amino acid sequence QSSDLTR (SEQ ID NO:1450). In other embodiments, S2 comprises GCT and F2 comprises the amino acid sequence QSSDLTR (SEQ ID NO:1450). In other embodiments, S3 comprises GCT and F3 comprises the amino acid sequence QSSDLQR (SEQ ID NO:132). In other embodiments, S1 comprises GTA and F1 comprises the amino acid sequence QSGALTR (SEQ ID NO:1398). In other embodiments, S2 comprises GTA and F2 comprises the amino acid sequence QSGALAR (SEQ ID NO:3339). In other embodiments, S1 comprises GTG and F1 comprises the amino acid sequence RSDALTR (SEQ ID NO:153). In other embodiments, S2 comprises GTG and F2 comprises the amino acid sequence RSDALSR (SEQ ID NO:237). In other embodiments, S3 comprises GTG and F3 comprises the amino acid sequence RSDALTR (SEQ ID NO:153). In other embodiments, S1 comprises GTC and F1 comprises the amino acid sequence DRSALAR (SEQ ID NO:184). In other embodiments, S2 comprises GTC and F2 comprises the amino acid sequence DRSALAR (SEQ ID NO:184). In other embodiments, S3 comprises GTC and F3 comprises the amino acid sequence DRSALAR (SEQ ID NO:184).

Also provided are polypeptides comprising any of zinc finger proteins described herein. In certain embodiments, the polypeptide further comprises at least one functional domain. Also provided are polynucleotides encoding any of the polypeptides described herein. Thus, also provided are nucleic acid encoding zinc fingers, including all of the zinc fingers described above.

Also provided are segments of a zinc finger comprising a sequence of seven contiguous amino acids as shown herein. Also provided are nucleic acids encoding any of these segments and zinc fingers comprising the same.

Also provided are zinc finger proteins comprising first, second and third zinc fingers. The first, second and third zinc fingers comprise respectively first, second and third segments of seven contiguous amino acids as shown herein. Also provided are nucleic acids encoding such zinc finger proteins.

BRIEF DESCRIPTION OF THE DRAWINGS

FIG. 1 shows results of site selection analysis of two representative zinc finger proteins (leftmost 4 columns) and measurements of binding affinity for each of these proteins to their intended target sequences and to variant target sequences. (rightmost 3 columns). Analysis of ZFP1 is shown in the upper portion of the figure and analysis of ZFP2 is shown in the lower portion of the figure. For the site selection analyses, the amino acid sequences of residues −1 through +6 of the recognition helix of each of the three component zinc fingers (F3 (ZFP1, SEQ ID NO:130; ZFP2, SEQ ID NO:420), F2 (ZFP1, SEQ ID NO:1051; ZFP2, SEQ ID NO:889) and F1 (ZFP1, SEQ ID NO:395; ZFP2, SEQ ID NO:685)) are shown across the top row; the intended target sequence (divided into finger-specific target subsites) is shown across the second row, and a summary of the sequences bound is shown in the third row. Data for F3 is shown in the second column, data for F2 is shown in the third column, and data for F1 is shown in the third column.

Figure 4:
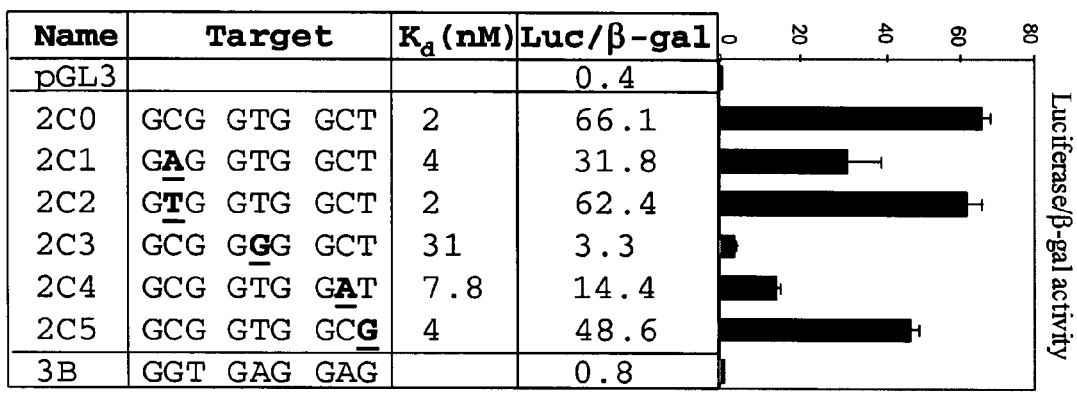

For the binding affinity analyses, the designed target sequence for each ZFP ("cognate") and two related sequences ("Mt") are shown (column 6), along with the $K_d$ for binding of the ZFP to each of these sequences (column 7).

FIG. 2 shows amino acid sequences of zinc finger recognition regions (amino acids −1 through +6 of the recognition helix) that bind to each of the 16 GNN triplet subsites. Three amino acid sequences are shown for each trinucleotide subsite; these correspond to optimal amino acid sequences for recognition of the subsite from each of the three positions (finger 1, F1 (SEQ ID NOS:688, 2534, 676, 1769, 342, 1450, 131, 158, 1765, 395, 1407, 2644, 705, 1398, 1733 & 184); finger 2, F2 (SEQ ID NOS:688, 229, 1446, 3051, 220, 1450, 417, 801, 1442, 395, 1824, 1201, 972, 3339, 1151 & 184); or finger 3, F3 (SEQ ID NOS:943, 229, 676, 1769, 220, 1365, 417, 801, 3525, 395, 1824, 1425, 972, 3592, 952 & 184)) in a three-finger zinc finger protein. Amino acid sequences are from N-terminal to C-terminal; nucleotide sequences are from 5' to 3'.

Also shown are site selection results for each of the 48 position-dependent GNN-recognizing zinc fingers. These show the number of times a particular nucleotide was present, at a given position, in a collection of oligonucleotide sequences bound by the finger. For example, out of 15 oligonucleotides bound by a zinc finger protein with the amino acid sequence QSGHLAR (SEQ ID NO:413) present at the finger 1 (F1) position, 15 contained a G in the 5'-most position of the subsite, 15 contained a G in the middle position of the subsite, while, at the 3'-most position of the subsite, 10 contained an A, 3 contained a G and 2 contained a T. Accordingly, this particular amino acid sequence is optimal for binding a GGA triplet from the F1 position.

FIGS. 3A, 3B and 3C show site selection data indicating positional dependence of GCA-, GAT- and GGT-binding zinc fingers. The first and fourth (where applicable) rows of each figure show portions of the amino acid sequence of a designed zinc finger protein (F1 column, SEQ ID NOS:220, 1765, 1442, 835 & 1425; F2 column, SEQ ID NOS:220, 1765, 1442, 889, 1425; F3 column, SEQ ID NOS:220, 159, 377, 889 & 1425). Amino acid residues −1 through +6 of each α-helix are listed from left to right. The second and fifth (where applicable) rows show the target sequence, divided into three triplet subsites, one for each finger of the protein shown in the first and fourth (where applicable) rows, respectively. The third and sixth (where applicable) rows show the distribution of nucleotides in the oligonucleotides obtained by site selection with the proteins shown in the first and fourth (where applicable) rows, respectively. FIG. 3A shows data for fingers designed to bind GCA; FIG. 3B shows data for fingers designed to bind GAT; FIG. 3C shows data for fingers designed to bind GGT.

FIGS. 4A and 4B show properties of the engineered ZFP EP2C. FIG. 4A shows site selection data. The first row provides the amino acid sequences (F3, SEQ ID NO:1100; F2, SEQ ID NO:237; F1, SEQ ID NO:1450) of residues −1 through +6 of the recognition helices for each of the three zinc fingers of the EP2C protein. The second row shows the target sequence (5' to 3'); with the distribution of nucleotides in the oligonucleotides obtained by site selection indicated below the target sequence.

FIG. 4B shows in vitro and in vivo assays for the binding specificity of EP2C. The first three columns show in vitro measurements of binding affinity of EP2C to its intended target sequence and several related sequences. The first column gives the name of each sequence (2C0 is the intended target sequence, compare to FIG. 4A). The second column shows the nucleotide sequence of various target sequences, with differences from the intended target sequence (2C0) highlighted. The third column shows the $K_d$ (in nM) for binding of EP2C to each of the target sequences. $K_d$s were determined by gel shift assays, using 2-fold dilution series of EP2C. The right side of the figure (fourth column and bar graph) shows relative luciferase activities (normalized to β-galactosidase levels) in stable cell lines in which expression of EP2C is inducible. Cells were co-transfected with a vector containing a luciferase coding region under the transcriptional control of the target sequence shown in the same row of the figure, and a control vector encoding β-galactosidase. Luciferase and β-galactosidase levels were measured after induction of EP2C expression. Triplicate samples were assayed and the standard deviations are shown in the bar graph. pGL3 is a luciferase-encoding vector lacking EP2C target sequences. 3B is another negative control, in which luciferase expression is under transcriptional control of sequences (3B) unrelated to the EP2C target sequence.

DEFINITIONS

A zinc finger DNA binding protein is a protein or segment within a larger protein that binds DNA in a sequence-specific manner as a result of stabilization of protein structure through coordination of a zinc ion. The term zinc finger DNA binding protein is often abbreviated as zinc finger protein or ZFP.

Zinc finger proteins can be engineered to recognize a selected target sequence in a nucleic acid. Any method known in the art or disclosed herein can be used to construct an engineered zinc finger protein or a nucleic acid encoding an engineered zinc finger protein. These include, but are not limited to, rational design, selection methods (e.g., phage display) random mutagenesis, combinatorial libraries, computer design, affinity selection, use of databases matching zinc finger amino acid sequences with target subsite nucleotide sequences, cloning from cDNA and/or genomic libraries, and synthetic constructions. An engineered zinc finger protein can comprise a new combination of naturally-occurring zinc finger sequences. Methods for engineering zinc finger proteins are disclosed in co-owned WO 00/41566 and WO 00/42219; as well as in WO 98/53057; WO 98/53058; WO 98/53059 and WO 98/53060; the disclosures of which are hereby incorporated by reference in their entireties. Methods for identifying preferred target sequences, and for engineering zinc finger proteins to bind to such preferred target sequences, are disclosed in co-owned WO 00/42219.

A designed zinc finger protein is a protein not occurring in nature whose design/composition results principally from rational criteria. Rational criteria for design include application of substitution rules and computerized algorithms for processing information in a database storing information of existing ZFP designs and binding data.

A selected zinc finger protein is a protein not found in nature whose production results primarily from an empirical process such as phage display.

The term naturally-occurring is used to describe an object that can be found in nature as distinct from being artificially produced by man. For example, a polypeptide or polynucleotide sequence that is present in an organism (including viruses) that can be isolated from a source in nature and which has not been intentionally modified by man in the laboratory is naturally-occurring. Generally, the term naturally-occurring refers to an object as present in a non-pathological (undiseased) individual, such as would be typical for the species.

A nucleic acid is operably linked when it is placed into a functional relationship with another nucleic acid sequence. For instance, a promoter or enhancer is operably linked to a coding sequence if it increases the transcription of the coding sequence. Operably linked means that the DNA sequences being linked are typically contiguous and, where necessary to join two protein coding regions, contiguous and in reading frame. However, since enhancers generally function when separated from the promoter by up to several kilobases or more and intronic sequences may be of variable lengths, some polynucleotide elements may be operably linked but not contiguous.

A specific binding affinity between, for example, a ZFP and a specific target site means a binding affinity of at least $1 \times 10^6 M^{-1}$.

The terms "modulating expression" "inhibiting expression" and "activating expression" of a gene refer to the ability of a zinc finger protein to activate or inhibit transcription of a gene. Activation includes prevention of subsequent transcriptional inhibition (i.e., prevention of repression of gene expression) and inhibition includes prevention of subsequent transcriptional activation (i.e., prevention of gene activation). Modulation can be assayed by determining any parameter that is indirectly or directly affected by the expression of the target gene. Such parameters include, e.g., changes in RNA or protein levels, changes in protein activity, changes in product levels, changes in downstream gene expression, changes in reporter gene transcription (luciferase, CAT, beta-galactosidase, GFP (see, e.g., Mistili & Spector, *Nature Biotechnology* 15:961-964 (1997)); changes in signal transduction, phosphorylation and dephosphorylation, receptor-ligand interactions, second messenger concentrations (e.g., cGMP, cAMP, IP3, and Ca2+), cell growth, neovascularization, in vitro, in vivo, and ex vivo. Such functional effects can be measured by any means known to those skilled in the art, e.g., measurement of RNA or protein levels, measurement of RNA stability, identification of downstream or reporter gene expression, e.g., via chemiluminescence, fluorescence, calorimetric reactions, antibody binding, inducible markers, ligand binding assays; changes in intracellular second messengers such as cGMP and inositol triphosphate (IP3); changes in intracellular calcium levels; cytokine release, and the like.

A "regulatory domain" refers to a protein or a protein subsequence that has transcriptional modulation activity. Typically, a regulatory domain is covalently or non-covalently linked to a ZFP to modulate transcription. Alternatively, a ZFP can act alone, without a regulatory domain, or with multiple regulatory domains to modulate transcription.

A D-able subsite within a target site has the motif 5'NNGK3' (SEQ ID NO:4084). A target site containing one or more such motifs is sometimes described as a D-able target site. A zinc finger appropriately designed to bind to a D-able subsite is sometimes referred to as a D-able finger. Likewise a zinc finger protein containing at least one finger designed or selected to bind to a target site including at least one D-able subsite is sometimes referred to as a D-able zinc finger protein.

DETAILED DESCRIPTION

I. General

Tables 1-5 list a collection of nonnaturally occurring zinc finger protein sequences and their corresponding target sites. The first column of each table is an internal reference number. The second column lists a 9 or 10 base target site bound by a three-finger zinc finger protein, with the target sites listed in 5' to 3' orientation. The third column provides SEQ ID NOs for the target site sequences listed in column 2. The fourth, sixth and eighth columns list amino acid residues from the first, second and third fingers, respectively, of a zinc finger protein which recognizes the target sequence listed in the second column. For each finger, seven amino acids, occupying positions −1 to +6 of the finger, are listed. The numbering convention for zinc fingers is defined below. Columns 5, 7 and 9 provide SEQ ID NOs for the amino acid sequences listed in columns 4, 6 and 8, respectively. The final column of each table lists the binding affinity (i.e., the $K_d$ in nM) of the zinc finger protein for its target site. Binding affinities are measured as described below.

Each finger binds to a triplet of bases within a corresponding target sequence. The first finger binds to the first triplet starting from the 3' end of a target site, the second finger binds to the second triplet, and the third finger binds the third (i.e., the 5'-most) triplet of the target sequence. For example, the RSDSLTS finger (SEQ ID NO: 646) of SBS#201 (Table 2) binds to 5'TTG3', the ERSTLTR finger (SEQ ID NO: 851) binds to 5'GCC3' and the QRADLRR finger (SEQ ID NO: 1056) binds to 5'GCA3'.

Table 6 lists a collection of consensus sequences for zinc fingers and the target sites bound by such sequences. Conventional one letter amino acid codes are used to designate amino acids occupying consensus positions. The symbol "X" designates a nonconsensus position that can in principle be occupied by any amino acid. In most zinc fingers of the $C_2H_2$ type, binding specificity is principally conferred by residues −1, +2, +3 and +6. Accordingly, consensus sequence determining binding specificity typically include at least these residues. Consensus sequences are useful for designing zinc fingers to bind to a given target sequence. Residues occupying other positions can be selected based on sequences in Tables 1-5, or other known zinc finger sequences. Alternatively, these positions can be randomized with a plurality of candidate amino acids and screened against one or more target sequences to refine binding specificity or improve binding specificity. In general, the same consensus sequence can be used for design of a zinc finger regardless of the relative position of that finger in a multi-finger zinc finger protein. For example, the sequence RXDNXXR (SEQ ID NO:4060) can be used to design a N-terminal, central or C-terminal finger of three finger protein. However, some consensus sequences are most suitable for designing a zinc finger to occupy a particular position in a multi-finger protein. For example, the consensus sequence RXDHXXQ (SEQ ID NO:4055) is most suitable for designing a C-terminal finger of a three-finger protein.

II. Characteristics of Zinc Finger Proteins

Zinc finger proteins are formed from zinc finger components. For example, zinc finger proteins can have one to thirty-seven fingers, commonly having 2, 3, 4, 5 or 6 fingers. A zinc finger protein recognizes and binds to a target site (sometimes referred to as a target segment) that represents a relatively small subsequence within a target gene. Each component finger of a zinc finger protein can bind to a subsite within the target site. The subsite includes a triplet of three contiguous bases all on the same strand (sometimes referred to as the target strand). The subsite may or may not also include a fourth base on the opposite strand that is the complement of the base immediately 3' of the three contiguous bases on the target strand. In many zinc finger proteins, a zinc finger binds to its triplet subsite substantially independently of other fingers in the same zinc finger protein. Accordingly, the binding specificity of zinc finger protein containing multiple fingers is usually approximately the aggregate of the specificities of its component fingers. For example, if a zinc finger protein is formed from first, second and third fingers that individually bind to triplets XXX, YYY, and ZZZ, the binding specificity of the zinc finger protein is 3'XXX YYY ZZZ5'.

The relative order of fingers in a zinc finger protein from N-terminal to C-terminal determines the relative order of triplets in the 3' to 5' direction in the target. For example, if a zinc finger protein comprises from N-terminal to C-terminal first, second and third fingers that individualy bind, respectively, to triplets 5' GAC3', 5'GTA3' and 5"'GGC3' then the zinc finger protein binds to the target segment 3'CAGAT-GCGG5'. If the zinc finger protein comprises the fingers in another order, for example, second finger, first finger, third finger, then the zinc finger protein binds to a target segment comprising a different permutation of triplets, in this example, 3'ATGCAGCGG5' (see Berg & Shi, *Science* 271, 1081-1086 (1996)). The assessment of binding properties of a zinc finger protein as the aggregate of its component fingers may, in some cases, be influenced by context-dependent interactions of multiple fingers binding in the same protein.

Two or more zinc finger proteins can be linked to have a target specificity that is the aggregate of that of the component zinc finger proteins (see e.g., Kim & Pabo, *PNAS* 95, 2812-2817 (1998)). For example, a first zinc finger protein having first, second and third component fingers that respectively bind to XXX, YYY and ZZZ can be linked to a second zinc finger protein having first, second and third component fingers with binding specificities, AAA, BBB and CCC. The binding specificity of the combined first and second proteins is thus 3'XXXYYYZZZ_____AAABBBCCC5', where the underline indicates a short intervening region (typically 0-5 bases of any type). In this situation, the target site can be viewed as comprising two target segments separated by an intervening segment.

Linkage can be accomplished using any of the following peptide linkers. T G E K P: (SEQ. ID. No:2) (Liu et al., 1997, supra.); (G4S)n (SEQ. ID. No:3) (Kim et al., *PNAS* 93, 1156-1160 (1996); GGRRGGGS; (SEQ. ID. No:4) LRQRDGERP; (SEQ. ID. No:5) LRQKDGGGSERP; (SEQ. ID. No:6) LRQKD(G3S)2 ERP (SEQ. ID. No:7) Alternatively, flexible linkers can be rationally designed using computer programs capable of modeling both DNA-binding sites and the peptides themselves or by phage display methods. In a further variation, noncovalent linkage can be achieved by fusing two zinc finger proteins with domains promoting heterodimer formation of the two zinc finger proteins. For example, one zinc finger protein can be fused with fos and the other with jun (see Barbas et al., WO 95/119431).

Linkage of two zinc finger proteins is advantageous for conferring a unique binding specificity within a mammalian genome. A typical mammalian diploid genome consists of $3 \times 10^9$ bp. Assuming that the four nucleotides A, C, G, and T are randomly distributed, a given 9 bp sequence is present ~23,000 times. Thus a ZFP recognizing a 9 bp target with absolute specificity would have the potential to bind to ~23,000 sites within the genome. An 18 bp sequence is present once in $3.4 \times 10^{10}$ bp, or about once in a random DNA sequence whose complexity is ten times that of a mammalian genome.

A component finger of zinc finger protein typically contains about 30 amino acids and has the following motif (N-C):

```
                              (SEQ. ID. No: 8)
Cys-(X)2-4-Cys-X.X.X.X.X.X.X.X.X.X.X-His-(X)3-5-
His

-1  1  2  3  4  5  6  7
```

The two invariant histidine residues and two invariant cysteine residues in a single beta turn are co-ordinated through zinc (see, e.g., Berg & Shi, *Science* 271, 1081-1085 (1996)). The above motif shows a numbering convention that is standard in the field for the region of a zinc finger conferring binding specificity. The amino acid on the left (N-terminal side) of the first invariant His residues is assigned the number +6, and other amino acids further to the left are assigned successively decreasing numbers. The alpha helix begins at residue 1 and extends to the residue following the second conserved histidine. The entire helix is therefore of variable length, between 11 and 13 residues.

The process of designing or selecting a nonnaturally occurring or variant ZFP typically starts with a natural ZFP as a source of framework residues. The process of design or selection serves to define nonconserved positions (i.e., positions −1 to +6) so as to confer a desired binding specificity. One suitable ZFP is the DNA binding domain of the mouse transcription factor Zif268. The DNA binding domain of this protein has the amino acid sequence: YACPVESCDRRF-SRSDELTRHIRIHTGQKP (F1) (SEQ. ID No:9) FQCRIC-MRNFSRSDHLTTHIRTHTGEKP (F2) (SEQ. ID. No:10) FACDICGRKFARSDERKRHTKIHLRQK (F3) SEQ. ID. No:11) and binds to a target 5' GCG TGG GCG 3' (SEQ ID No:12).

Another suitable natural zinc finger protein as a source of framework residues is Sp-1. The Sp-1 sequence used for construction of zinc finger proteins corresponds to amino acids 531 to 624 in the Sp-1 transcription factor. This sequence is 94 amino acids in length. The amino acid sequence of Sp-1 is as follows: PGKKKQHICH-IQGCGKVYGKTSHLRAHLRWHTGERP FMCTWSY-CGKRFTRSDELQRHKRTHTGEKK FACPECP-KRFMRSDHLSKHIKTHQNKKG (SEQ. ID. No:13) Sp-1 binds to a target site 5'GGG GCG GGG3' (SEQ ID No: 14).

An alternate form of Sp-1, an Sp-1 consensus sequence, has the following amino acid sequence: meklrngsgd PGKKKQHACPECGKSFSKSSHLRAHQRTHTGERP YKCPECGKSFSRSDELQRHQRTHTGEKP YKCPECGKSFSRSDHLSKHQRTHQNKKG (SEQ. ID. NO:15) (lower case letters are a leader sequence from Shi & Berg, *Chemistry and Biology* 1, 83-89. (1995). The optimal binding sequence for the Sp-1 consensus sequence is 5'GGGGCGGGG3' (SEQ ID NO: 16). Other suitable ZFPs are described below.

There are a number of substitution rules that assist rational design of some zinc finger proteins (see Desjarlais & Berg, *PNAS* 90, 2256-2260 (1993); Choo & Klug, *PNAS* 91, 11163-11167 (1994); Desjarlais & Berg, *PNAS* 89, 7345-7349 (1992); Jamieson et al., supra; Choo et al., WO 98/53057, WO 98/53058; WO 98/53059; WO 98/53060). Many of these rules are supported by site-directed mutagenesis of the three-finger domain of the ubiquitous transcription factor, Sp-1 (Desjarlais and Berg, 1992; 1993). One of these rules is that a 5' G in a DNA triplet can be bound by a zinc finger incorporating arginine at position 6 of the recognition helix. Another substitution rule is that a G in the middle of a subsite can be recognized by including a histidine residue at position 3 of a zinc finger. A further substitution rule is that asparagine can be incorporated to recognize A in the middle of triplet, aspartic acid, glutamic acid, serine or threonine can be incorporated to recognize C in the middle of triplet, and amino acids with small side chains such as alanine can be incorporated to recognize T in the middle of triplet. A further substitution rule is that the 3' base of triplet subsite can be recognized by incorporating the following amino acids at position −1 of the recognition helix: arginine to recognize G, glutamine to recognize A, glutamic acid (or aspartic acid) to recognize C, and threonine to recognize T. Although these substitution rules are useful in designing zinc finger proteins they do not take into account all possible target sites. Furthermore, the assumption underlying the rules, namely that a particular amino acid in a zinc finger is responsible for binding to a particular base in a subsite is only approximate. Context-dependent interactions between proximate amino acids in a finger or binding of multiple amino acids to a single base or vice versa can cause variation of the binding specificities predicted by the existing substitution rules.

The technique of phage display provides a largely empirical means of generating zinc finger proteins with a desired target specificity (see e.g., Rebar, U.S. Pat. No. 5,789,538; Choo et al., WO 96/06166; Barbas et al., WO 95/19431 and WO 98/543111; Jamieson et al., supra). The method can be used in conjunction with, or as an alternative to rational design. The method involves the generation of diverse libraries of mutagenized zinc finger proteins, followed by the isolation of proteins with desired DNA-binding properties using affinity selection methods. To use this method, the experimenter typically proceeds as follows. First, a gene for a zinc finger protein is mutagenized to introduce diversity into regions important for binding specificity and/or affinity. In a typical application, this is accomplished via randomization of a single finger at positions −1, +2, +3, and +6, and sometimes accessory positions such as +1, +5, +8 and +10. Next, the mutagenized gene is cloned into a phage or phagemid vector as a fusion with gene III of a filamentous phage, which encodes the coat protein pIII. The zinc finger gene is inserted between segments of gene III encoding the membrane export signal peptide and the remainder of pIII, so that the zinc finger protein is expressed as an amino-terminal fusion with pIII or in the mature, processed protein. When using phagemid vectors, the mutagenized zinc finger gene may also be fused to a truncated version of gene III encoding, minimally, the C-terminal region required for assembly of pIII into the phage particle. The resultant vector library is transformed into *E. coli* and used to produce filamentous phage which express variant zinc finger proteins on their surface as fusions with the coat protein pIII. If a phagemid vector is used, then the this step requires superinfection with helper phage. The phage library is then incubated with target DNA site, and affinity selection methods are used to isolate phage which bind target with high affinity from bulk phage. Typically, the DNA target is immobilized on a solid support, which is then washed under conditions sufficient to remove all but the tightest binding phage. After washing, any phage remaining on the support are recovered via elution under conditions which disrupt zinc finger-DNA binding. Recovered phage are used to infect fresh *E. coli*, which is then amplified and used to produce a new batch of phage particles. Selection and amplification are then repeated as many times as is necessary to enrich the phage pool for tight binders such that these may be identified using sequencing and/or screening methods. Although the method is illustrated for pIII fusions, analogous principles can be used to screen ZFP variants as pVIII fusions.

In certain embodiments, the sequence bound by a particular zinc finger protein is determined by conducting binding reactions (see, e.g., conditions for determination of $K_d$, infra) between the protein and a pool of randomized double-stranded oligonucleotide sequences. The binding reaction is analyzed by an electrophoretic mobility shift assay (EMSA), in which protein-DNA complexes undergo retarded migration in a gel and can be separated from unbound nucleic acid. Oligonucleotides which have bound the finger are purified from the gel and amplified, for example, by a polymerase chain reaction. The selection (i.e. binding reaction and EMSA analysis) is then repeated as many times as desired, with the selected oligonucleotide sequences. In this way, the binding specificity of a zinc finger protein having a particular amino acid sequence is determined.

Zinc finger proteins are often expressed with a heterologous domain as fusion proteins. Common domains for addition to the ZFP include, e.g., transcription factor domains (activators, repressors, co-activators, co-repressors), silencers, oncogenes (e.g., myc, jun, fos, myb, max, mad, rel, ets, bcl, myb, mos family members etc.); DNA repair enzymes and their associated factors and modifiers; DNA rearrangement enzymes and their associated factors and modifiers; chromatin associated proteins and their modifiers (e.g. kinases, acetylases and deacetylases); and DNA modifying enzymes (e.g., methyltransferases, topoisomerases, helicases, ligases, kinases, phosphatases, polymerases, endonucleases) and their associated factors and modifiers. A preferred domain for fusing with a ZFP when the ZFP is to be used for repressing expression of a target gene is a KRAB repression domain from the human KOX-1 protein (Thiesen et al., *New Biologist* 2, 363-374 (1990); Margolin et al., *Proc. Natl. Acad. Sci. USA* 91, 4509-4513 (1994); Pengue et al., *Nucl. Acids Res.* 22:2908-2914 (1994); Witzgall et al., *Proc. Natl. Acad. Sci. USA* 91, 4514-4518 (1994). Preferred domains for achieving activation include the HSV VP16 activation domain (see, e.g., Hagmann et al., *J. Virol.* 71, 5952-5962 (1997)) nuclear hormone receptors (see, e.g., Torchia et al., *Curr. Opin. Cell. Biol.* 10:373-383 (1998)); the p65 subunit of nuclear factor kappa B (Bitko & Barik, *J. Virol.*

72:5610-5618 (1998) and Doyle & Hunt, *Neuroreport* 8:2937-2942 (1997)); Liu et al., *Cancer Gene Ther.* 5:3-28 (1998)), or artificial chimeric functional domains such as VP64 (Seifpal et al., *EMBO J.* 11, 4961-4968 (1992)).

An important factor in the administration of polypeptide compounds, such as the ZFPs, is ensuring that the polypeptide has the ability to traverse the plasma membrane of a cell, or the membrane of an intra-cellular compartment such as the nucleus. Cellular membranes are composed of lipid-protein bilayers that are freely permeable to small, nonionic lipophilic compounds and are inherently impermeable to polar compounds, macromolecules, and therapeutic or diagnostic agents. However, proteins and other compounds such as liposomes have been described, which have the ability to translocate polypeptides such as ZFPs across a cell membrane.

For example, "membrane translocation polypeptides" have amphiphilic or hydrophobic amino acid subsequences that have the ability to act as membrane-translocating carriers. In one embodiment, homeodomain proteins have the ability to translocate across cell membranes. The shortest internalizable peptide of a homeodomain protein, Antennapedia, was found to be the third helix of the protein, from amino acid position 43 to 58 (see, e.g., Prochiantz, *Current Opinion in Neurobiology* 6:629-634 (1996)). Another subsequence, the h (hydrophobic) domain of signal peptides, was found to have similar cell membrane translocation characteristics (see, e.g., Lin et al., *J. Biol. Chem.* 270:1 4255-14258 (1995)).

Examples of peptide sequences which can be linked to a ZFP, for facilitating uptake of ZFP into cells, include, but are not limited to: an 11 amino acid peptide of the tat protein of HIV; a 20 residue peptide sequence which corresponds to amino acids 84-103 of the p16 protein (see Fahraeus et al., *Current Biology* 6:84 (1996)); the third helix of the 60-amino acid long homeodomain of Antennapedia (Derossi et al., *J. Biol. Chem.* 269:10444 (1994)); the h region of a signal peptide such as the Kaposi fibroblast growth factor (K-FGF) h region (Lin et al., supra); or the VP22 translocation domain from HSV (Elliot & O'Hare, *Cell* 88:223-233 (1997)). Other suitable chemical moieties that provide enhanced cellular uptake may also be chemically linked to ZFPs.

Toxin molecules also have the ability to transport polypeptides across cell membranes. Often, such molecules are composed of at least two parts (called "binary toxins"): a translocation or binding domain or polypeptide and a separate toxin domain or polypeptide. Typically, the translocation domain or polypeptide binds to a cellular receptor, and then the toxin is transported into the cell. Several bacterial toxins, including *Clostridium perfringens* iota toxin, diphtheria toxin (DT), *Pseudomonas* exotoxin A (PE), pertussis toxin (PT), *Bacillus anthracis* toxin, and pertussis adenylate cyclase (CYA), have been used in attempts to deliver peptides to the cell cytosol as internal or amino-terminal fusions (Arora et al., *J. Biol. Chem.*, 268:3334-3341 (1993); Perelle et al., *Infect. Immun.,* 61:5147-5156 (1993); Stenmark et al., *J. Cell Biol.* 113:1025-1032 (1991); Donnelly et al., *PNAS* 90:3530-3534 (1993); Carbonetti et al., *Abstr. Annu. Meet. Am. Soc. Microbiol.* 95:295 (1995); Sebo et al., *Infect. Immun.* 63:3851-3857 (1995); Klimpel et al., *PNAS U.S.A.* 89:10277-10281 (1992); and Novak et al., *J. Biol. Chem.* 267:17186-17193 1992)).

Such subsequences can be used to translocate ZFPs across a cell membrane. ZFPs can be conveniently fused to or derivatized with such sequences. Typically, the translocation sequence is provided as part of a fusion protein. Optionally, a linker can be used to link the ZFP and the translocation sequence. Any suitable linker can be used, e.g., a peptide linker.

III. Position Dependence of Subsite Recognition by Zinc Fingers

A number of the polypeptides disclosed herein have been characterized using the methods disclosed in U.S. Pat. No. 6,794,136; which matured from a grandparent of the present application (the disclosure of which is hereby incorporated by reference in its entirety); in particular with respect to the effect of their position, within a multi-finger protein, on their sequence specificity. The results of these investigations provide a set of zinc finger sequences that are optimized for recognition of certain triplet target subsites whose 5'-most nucleotide is a G (i.e., GNN triplet subsites). Thus, particular zinc finger sequences which recognize each of the GNN triplet subsites, from each position of a three-finger zinc finger protein, are provided. See FIG. 2. It will be clear to those of skill in the art that the optimized, position-specific zinc finger sequences disclosed herein for recognition of GNN target subsites are not limited to use in three-finger proteins. For example, they are also useful in six-finger proteins, which can be made by linkage of two three-finger proteins.

A number of zinc finger amino acid sequences which are reported to bind to target subsites in which the 5'-most nucleotide residue is G (i.e., GNN subsites) have recently been disclosed. Segal et al. (1999) *Proc. Natl. Acad. Sci. USA* 96:2758-2763; Drier et al. (2000) *J. Mol. Biol.* 303:489-502; U.S. Pat. No. 6,140,081. These GNN-binding zinc fingers were obtained by selection of finger 2 sequences from phage display libraries of three-finger proteins, in which certain amino acid residues of finger 2 had been randomized. Due to the manner in which they were selected, it is not clear whether these sequences would have the same target subsite specificity if they were present in the F1 and/or F3 positions.

Use of the methods and compositions disclosed herein has now allowed identification of specific zinc finger sequences that bind each of the 16 GNN triplet subsites, and for the first time, provides zinc finger sequences that are optimized for recognition of these triplet subsites in a position-dependent fashion. Moreover, in vivo studies of these optimized designs reveal that the functionality of a ZFP is correlated with its binding affinity to its target sequence. See Example 6, infra.

As a result of the discovery, disclosed herein, that sequence recognition by zinc fingers is position-dependent, it is clear that existing design rules will not, in and of themselves, be applicable to every situation in which it is necessary to construct a sequence-specific ZFP. The results disclosed herein show that many zinc fingers that are constructed based on design rules exhibit the sequence specificity predicted by those design rules only at certain finger positions. The position-specific zinc fingers disclosed herein are likely to function more efficiently in vivo and in cultured cells, with fewer nonspecific effects. Highly specific ZFPs, made using position-specific zinc fingers, will be useful tools in studying gene function and will find broad applications in areas as diverse as human therapeutics and plant engineering.

IV. Production of Zinc Finger Proteins

ZFP polypeptides and nucleic acids encoding the same can be made using routine techniques in the field of recombinant genetics. Basic texts disclosing the general methods include Sambrook et al., *Molecular Cloning, A Laboratory Manual* (2nd ed. 1989); Kriegler, *Gene Transfer and Expression: A Laboratory Manual* (1990); and *Current Protocols in Molecular Biology* (Ausubel et al., eds., 1994)). In addition, nucleic acids less than about 100 bases can be custom ordered from any of a variety of commercial sources, such as The Midland Certified Reagent Company (mcrc@oligos.com), The Great American Gene Company (http://www.genco.com), ExpressGen Inc. (www.expressgen.com), Operon Technologies Inc. (Alameda, Calif.). Similarly, peptides can be custom ordered from any of a variety of sources, such as PeptidoGenic (pkim@ccnet.com), HTI Bio-products, inc. (http://www.htibio.com), BMA Biomedicals Ltd (U.K.), Bio.Synthesis, Inc.

Oligonucleotides can be chemically synthesized according to the solid phase phosphoramidite triester method first described by Beaucage & Caruthers, *Tetrahedron Letts.* 22:1859-1862 (1981), using an automated synthesizer, as described in Van Devanter et al., *Nucleic Acids Res.* 12:6159-6168 (1984). Purification of oligonucleotides is by either denaturing polyacrylamide gel electrophoresis or by reverse phase HPLC. The sequence of the cloned genes and synthetic oligonucleotides can be verified after cloning using, e.g., the chain termination method for sequencing double-stranded templates of Wallace et al., *Gene* 16:21-26 (1981).

Two alternative methods are typically used to create the coding sequences required to express newly designed DNA-binding peptides. One protocol is a PCR-based assembly procedure that utilizes six overlapping oligonucleotides (FIG. 1). Three oligonucleotides (oligos 1, 3, and 5 in FIG. 1) correspond to "universal" sequences that encode portions of the DNA-binding domain between the recognition helices. These oligonucleotides typically remain constant for all zinc finger constructs. The other three "specific" oligonucleotides (oligos 2, 4, and 6 in FIG. 1) are designed to encode the recognition helices. These oligonucleotides contain substitutions primarily at positions $-1, 2, 3$ and $6$ on the recognition helices making them specific for each of the different DNA-binding domains.

The PCR synthesis is carried out in two steps. First, a double stranded DNA template is created by combining the six oligonucleotides (three universal, three specific) in a four cycle PCR reaction with a low temperature annealing step, thereby annealing the oligonucleotides to form a DNA "scaffold." The gaps in the scaffold are filled in by high-fidelity thermostable polymerase, the combination of Taq and Pfu polymerases also suffices. In the second phase of construction, the zinc finger template is amplified by external primers designed to incorporate restriction sites at either end for cloning into a shuttle vector or directly into an expression vector.

An alternative method of cloning the newly designed DNA-binding proteins relies on annealing complementary oligonucleotides encoding the specific regions of the desired ZFP. This particular application requires that the oligonucleotides be phosphorylated prior to the final ligation step. This is usually performed before setting up the annealing reactions. In brief, the "universal" oligonucleotides encoding the constant regions of the proteins (oligos 1, 2 and 3 of above) are annealed with their complementary oligonucleotides. Additionally, the "specific" oligonucleotides encoding the finger recognition helices are annealed with their respective complementary oligonucleotides. These complementary oligos are designed to fill in the region which was previously filled in by polymerase in the above-mentioned protocol. The complementary oligos to the common oligos 1 and finger 3 are engineered to leave overhanging sequences specific for the restriction sites used in cloning into the vector of choice in the following step. The second assembly protocol differs from the initial protocol in the following aspects: the "scaffold" encoding the newly designed ZFP is composed entirely of synthetic DNA thereby eliminating the polymerase fill-in step, additionally the fragment to be cloned into the vector does not require amplification. Lastly, the design of leaving sequence-specific overhangs eliminates the need for restriction enzyme digests of the inserting fragment. Alternatively, changes to ZFP recognition helices can be created using conventional site-directed mutagenesis methods.

Both assembly methods require that the resulting fragment encoding the newly designed ZFP be ligated into a vector. Ultimately, the ZFP-encoding sequence is cloned into an expression vector. Expression vectors that are commonly utilized include, but are not limited to, a modified pMAL-c2 bacterial expression vector (New England BioLabs or an eukaryotic expression vector, pcDNA (Promega). The final constructs are verified by sequence analysis.

Any suitable method of protein purification known to those of skill in the art can be used to purify ZFPs (see, Ausubel, supra, Sambrook, supra). In addition, any suitable host can be used for expression, e.g., bacterial cells, insect cells, yeast cells, mammalian cells, and the like.

Expression of a zinc finger protein fused to a maltose binding protein (MBP-ZFP) in bacterial strain JM109 allows for straightforward purification through an amylose column (NEB). High expression levels of the zinc finger chimeric protein can be obtained by induction with IPTG since the MBP-ZFP fusion in the pMal-c2 expression plasmid is under the control of the tac promoter (NEB). Bacteria containing the MBP-ZFP fusion plasmids are inoculated into 2×YT medium containing 10 μM ZnCl2, 0.02% glucose, plus 50 μg/ml ampicillin and shaken at 37° C. At mid-exponential growth IPTG is added to 0.3 mM and the cultures are allowed to shake. After 3 hours the bacteria are harvested by centrifugation, disrupted by sonication or by passage through a french pressure cell or through the use of lysozyme, and insoluble material is removed by centrifugation. The MBP-ZFP proteins are captured on an amylose-bound resin, washed extensively with buffer containing 20 mM Tris-HCl (pH 7.5), 200 mM NaCl, 5 mM DTT and 50 μM ZnCl2, then eluted with maltose in essentially the same buffer (purification is based on a standard protocol from NEB). Purified proteins are quantitated and stored for biochemical analysis.

The dissociation constants of the purified proteins, e.g., Kd, are typically characterized via electrophoretic mobility shift assays (EMSA) (Buratowski & Chodosh, in *Current Protocols in Molecular Biology* pp. 12.2.1-12.2.7 (Ausubel ed., 1996)). Affinity is measured by titrating purified protein against a fixed amount of labeled double-stranded oligonucleotide target. The target typically comprises the natural binding site sequence flanked by the 3 bp found in the natural sequence and additional, constant flanking sequences. The natural binding site is typically 9 bp for a three-finger protein and 2×9 bp+intervening bases for a six finger ZFP. The annealed oligonucleotide targets possess a 1 base 5' overhang which allows for efficient labeling of the target with T4 phage polynucleotide kinase. For the assay the target is added at a concentration of 1 nM or lower (the actual concentration is kept at least 10-fold lower than the expected dissociation constant), purified ZFPs are added at various concentrations, and the reaction is allowed to equilibrate for at least 45 min. In addition the reaction mixture also contains 10 mM Tris (pH 7.5), 100 mM KCl, 1 mM MgCl2, 0.1 mM ZnCl2, 5 mM DTT, 10% glycerol, 0.02% BSA. (NB: in earlier assays poly d(IC) was also added at 10-100 μg/μl.)

The equilibrated reactions are loaded onto a 10% polyacrylamide gel, which has been pre-run for 45 min in Tris/glycine buffer, then bound and unbound labeled target is resolved by electrophoresis at 150V. (alternatively, 10-20% gradient Tris-HCl gels, containing a 4% polyacrylamide stacker, can be used) The dried gels are visualized by autoradiography or phosphorimaging and the apparent Kd is determined by calculating the protein concentration that gives half-maximal binding.

The assays can also include determining active fractions in the protein preparations. Active fractions are determined by stoichiometric gel shifts where proteins are titrated against a high concentration of target DNA. Titrations are done at 100, 50, and 25% of target (usually at micromolar levels).

V. Applications of Engineered Zinc Finger Proteins

ZPFs that bind to a particular target gene, and the nucleic acids encoding them, can be used for a variety of applications. These applications include therapeutic methods in which a ZFP or a nucleic acid encoding it is administered to a subject and used to modulate the expression of a target gene within the subject. See, for example, co-owned WO 00/41566. The modulation can be in the form of repression, for example, when the target gene resides in a pathological infecting microrganisms, or in an endogenous gene of the patient, such as an oncogene or viral receptor, that is contributing to a disease state. Alternatively, the modulation can be in the form of activation when activation of expression or increased expression of an endogenous cellular gene can ameliorate a diseased state. For such applications, ZFPs, or more typically, nucleic acids encoding them are formulated with a pharmaceutically acceptable carrier as a pharmaceutical composition.

Pharmaceutically acceptable carriers are determined in part by the particular composition being administered, as well as by the particular method used to administer the composition. (see, e.g., *Remington's Pharmaceutical Sciences*, 17$^{th}$ ed. 1985)). The ZFPs, alone or in combination with other suitable components, can be made into aerosol formulations (i.e., they can be "nebulized") to be administered via inhalation. Aerosol formulations can be placed into pressurized acceptable propellants, such as dichlorodifluoromethane, propane, nitrogen, and the like. Formulations suitable for parenteral administration, such as, for example, by intravenous, intramuscular, intradermal, and subcutaneous routes, include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. Compositions can be administered, for example, by intravenous infusion, orally, topically, intraperitoneally, intravesically or intrathecally. The formulations of compounds can be presented in unit-dose or multi-dose sealed containers, such as ampules and vials. Injection solutions and suspensions can be prepared from sterile powders, granules, and tablets of the kind previously described.

The dose administered to a patient should be sufficient to effect a beneficial therapeutic response in the patient over time. The dose is determined by the efficacy and $K_d$ of the particular ZFP employed, the target cell, and the condition of the patient, as well as the body weight or surface area of the patient to be treated. The size of the dose also is determined by the existence, nature, and extent of any adverse side-effects that accompany the administration of a particular compound or vector in a particular patient In other applications, ZFPs are used in diagnostic methods for sequence specific detection of target nucleic acid in a sample. For example, ZFPs can be used to detect variant alleles associated with a disease or phenotype in patient samples. As an example, ZFPs can be used to detect the presence of particular mRNA species or cDNA in a complex mixtures of mRNAs or cDNAs. As a further example, ZFPs can be used to quantify copy number of a gene in a sample. For example, detection of loss of one copy of a p53 gene in a clinical sample is an indicator of susceptibility to cancer. In a further example, ZFPs are used to detect the presence of pathological microorganisms in clinical samples. This is achieved by using one or more ZFPs specific to genes within the microorganism to be detected. A suitable format for performing diagnostic assays employs ZFPs linked to a domain that allows immobilization of the ZFP on an ELISA plate. The immobilized ZFP is contacted with a sample suspected of containing a target nucleic acid under conditions in which binding can occur. Typically, nucleic acids in the sample are labeled (e.g., in the course of PCR amplification). Alternatively, unlabelled probes can be detected using a second labelled probe. After washing, bound-labelled nucleic acids are detected.

ZFPs also can be used for assays to determine the phenotype and function of gene expression. Current methodologies for determination of gene function rely primarily upon either overexpression or removing (knocking out completely) the gene of interest from its natural biological setting and observing the effects. The phenotypic effects observed indicate the role of the gene in the biological system.

One advantage of ZFP-mediated regulation of a gene relative to conventional knockout analysis is that expression of the ZFP can be placed under small molecule control. By controlling expression levels of the ZFPs, one can in turn control the expression levels of a gene regulated by the ZFP to determine what degree of repression or stimulation of expression is required to achieve a given phenotypic or biochemical effect. This approach has particular value for drug development. By putting the ZFP under small molecule control, problems of embryonic lethality and developmental compensation can be avoided by switching on the ZFP repressor at a later stage in mouse development and observing the effects in the adult animal. Transgenic mice having target genes regulated by a ZFP can be produced by integration of the nucleic acid encoding the ZFP at any site in trans to the target gene. Accordingly, homologous recombination is not required for integration of the nucleic acid. Further, because the ZFP is trans-dominant, only one chromosomal copy is needed and therefore functional knock-out animals can be produced without backcrossing.

All references cited above are hereby incorporated by reference in their entirety for all purposes.

EXAMPLES

Example 1

Initial Design of Zinc Finger Proteins and Determination of Binding Affinity

Initial ZFP designs were based on existing design rules, correspondence regimes and ZFP directories, including those disclosed herein (see Tables 1-5) and also in WO 98/53058; WO 98/530059; WO 98/53060 and co-owned U.S. patent application Ser. No. 09/444,241. See also WO 00/42219. Amino acid sequences were conceptually designed using amino acids 532-624 of the human transcription factor Sp1 as a backbone. Polynucleotides encoding designed ZFPs were assembled using a Polymerase Chain Reaction (PCR)-based procedure that utilizes six overlapping oligonucleotides. PCR products were directly cloned cloning into the Tac promoter vector, pMal-c2 (New England Biolabs, Beverly, Mass.)

using the KpnI and BamHI restriction sites. The encoded maltose binding protein-ZFP fusion polypeptides were purified according to the manufacturer's procedures (New England Biolabs, Beverly, Mass.). Binding affinity was measured by gel mobility-shift analysis. All of these procedures are described in detail in co-owned WO 00/41566 and WO 00/42219, as well as in Zhang et al. (2000) *J. Biol. Chem.* 275:33,850-33,860 and Liu et al. (2001) *J. Biol. Chem.* 276: 11,323-11,334; the disclosures of which are hereby incorporated by reference in their entireties.

Example 2

Optimization of Binding Specificity by Site Selection

Designed ZFPs were tested for binding specificity using site selection methods disclosed in parent application U.S. Ser. No. 09/716,637 filed Nov. 20, 2000, now U.S. Pat. No. 6,794,136. Briefly, designed proteins were incubated with a population of labeled, double-stranded oligonucleotides comprising a library of all possible 9- or 10-nucleotide target sequences. Five nanomoles of labeled oligonucleotides were incubated with protein, at a protein concentration 4-fold above its $K_d$ for its target sequence. The mixture was subjected to gel electrophoresis, and bound oligonucleotides were identified by mobility shift, and extracted from the gel. The purified bound oligonucleotides were amplified, and the amplification products were used for a subsequent round of selection. At each round of selection, the protein concentration was decreased by 2 fold. After 3-5 rounds of selection, amplification products were cloned into the TOPO TA cloning vector (Invitrogen, Carlsbad, Calif.), and the nucleotide sequences of approximately 20 clones were determined. The identities of the target sites bound by a designed protein were determined from the sequences and expressed as a compilation of subsite binding sequences.

Example 3

Comparison of Site Selection Results with Binding Affinity

To test the correlation between site selection results and the affinity of binding of a ZFP to various related targets, site selection experiments were conducted on 2 three-finger ZFPs, denoted ZFP1 and ZFP2, and the site selection results were compared with $K_d$ measurements obtained from quantitative gel-mobility shift assays using the same ZFPs and target sites. Each ZFP was constructed, based on design rules, to bind to a particular nine-nucleotide target sequence (comprising 3 three-nucleotide subsites), as shown in FIG. 1. Site selection results and affinity measurements are also shown in FIG. 1. The site selection results showed that fingers 1 and 3 of both the ZFP1 and ZFP2 proteins preferentially selected their intended target sequences. However, the second finger of each ZFP preferentially selected subsites other than those to which they were designed to bind (e.g., F2 of ZFP1 was designed to bind TCG, but preferentially selected GTG; F2 of ZFP2 was designed to bind GGT, but preferentially selected GGA).

To confirm the site selection results, binding affinities of ZFP1 and ZFP2 were measured (see Example 1, supra), both to their original target sequences and to new target sequences reflecting the site selection results. For example, the Mt-1 sequence contains two base changes (compared to the original target sequence for ZFP1) which result in a change in the sequence of the finger 2 subsite to GTG, reflecting the preferred finger 2 subsite sequence obtained by site selection. In agreement with the site selection results, binding of ZFP1 to the Mt-1 sequence is approximately 4-fold stronger than its binding to the original target sequence ($K_d$ of 12.5 nM compared to a $K_d$ of 50 nM, see FIG. 1).

For ZFP2, the specificity of finger 2 for the 3' base of its target subsite was tested, since, although this finger was designed to bind GGT, site selection indicated that it bound preferentially to GGA. Moreover, the site selection results predicted that finger 2 of ZFP2 would bind with approximately equal affinity to GGT and GGC. Accordingly, target sequences containing GGA (Mt-3) and GGC (Mt-4) at the finger 2 subsite were constructed, and binding affinities of ZFP2 to these target sequences, and to its original target sequence (containing GGT at the finger 2 subsite), were compared. In complete agreement with the site selection results, ZFP2 exhibited the strongest binding affinity for the target sequence containing GGA at the finger 2 subsite ($K_d$ of 0.5 nM, FIG. 1), and its affinity for target sequences containing either GGT or GGC at the finger 2 subsite was approximately equal ($K_d$ of 1 nM for both targets, FIG. 1). Accordingly, the site selection method, in addition to being useful for iterative optimization of binding specificity, can also be used as a useful indicator of binding affinity.

Example 4

Use of Site Selection to Identify Position-Dependent, GNN-Binding Zinc Fingers

A large number of engineered ZFPs have been evaluated, by site selection, to identify zinc fingers that bind to GNN target subsites. In the course of these studies, it became apparent that the binding specificity of a particular zinc finger sequence is, in some instances, dependent upon the position of the zinc finger in the protein, and hence upon the location of the target subsite within the target sequence. For example, if one wishes to design a three-finger zinc finger protein to bind to a target sequence containing the triplet subsite GAT, it is necessary to know whether this subsite is the first, second or third subsite in the target sequence (i.e., whether the GAT subsite will be bound by the first, second or third finger of the protein). Accordingly, over 110 three-finger zinc finger proteins, containing potential GNN-recognizing zinc fingers in various locations, have been evaluated by site selection experiments. Generally, several zinc finger sequences were designed to recognize each GNN triplet, and each design was tested in each of the F1, F2 and F3 positions through 4 to 6 rounds of selection.

The results of these analyses, shown in FIG. 2, provide optimal position-dependent zinc finger sequences (the sequences shown represent amino acid residues −1 through +6 of the recognition helix portion of the finger) for recognition of the 16 GNN target subsites, as well as site selection results for these GNN-specific zinc fingers. Optimal amino acid sequences for recognition of each GNN subsite from each of three positions (finger 1, finger 2 or finger 3) are thereby provided.

GNG-Binding Finger Designs

The amino acid sequence RSDXLXR (SEQ ID NO:4085) (position −1 to +6 of the recognition helix) was found to be optimal for binding to the four GNG triplets, with $Asn^{+3}$ specifying A as the middle nucleotide; $His^{+3}$ specifying G as the middle nucleotide; $Ala^{+3}$ specifying T as the middle nucleotide; and $Asp^{+3}$ specifying cytosine as the middle nucleotide. At the +5 position, Ala, Thr, Ser, and Gln, were tested, and all showed similar specificity profiles by site selection. Interestingly, and in contrast to a previous report (Swirnoff et al. (1995) *Mol. Cell. Biol.* 15:2275-2287), site selection results indicated that three naturally-occurring GCG-binding fingers from zif268 and Sp1, having the amino acid sequences RSDELTR (SEQ ID NO:123), RSDELQR (SEQ ID NO:302), and RSDERKR (SEQ ID NO:1100), were not GCG-specific. Rather, each of these fingers selected almost equal numbers of GCG and GTG sequences. Analysis of binding affinity by gel-shift experiments confirmed that finger 3 of zif268, having the sequence RSDERKR (SEQ ID NO:1000), binds GCG and GTG with approximately equal affinity.

Position Dependence of GCA-, GAT-, GGT-, GAA- and GCC-Binding Fingers

Based on existing design rules, the amino acid sequence QSGDLTR (SEQ ID NO:220) (−1 through +6) was tested for its ability to bind the GCA triplet from three positions (F1, F2, and F3) within a three-finger ZFP. FIG. 3A shows that the QSGDLTR (SEQ ID NO:220) sequence bound preferentially to the GCA triplet subsite from the F2 and F3 positions, but not from F1. In fact, the presence of QSGDLTR (SEQ ID NO:220) at the F1 position of three different three-finger ZFPs resulted predominantly in selection of GCT. Accordingly, an attempt was made to redesign this sequence to obtain specificity for GCA from the F1 position. Since the sequence $Q^{-1}G^{+2}S^{+3}R^{+6}$ (SEQ ID NO:4065) had previously been selected from a randomized F1 library using GCA as target (Rebar et al. (1994) *Science* 263:671-673), a D (asp) to S (ser) change was made at the +3 residue of this finger. The resulting sequence, QSGSLTR (SEQ ID NO:342), was tested for its binding specificity by site selection and found to preferentially bind GCA, from the F1 position, in three different ZFPs (see FIG. 2).

The QSGSLTR (SEQ ID NO:342) zinc finger, optimized for recognition of the GCA subsite from the F1 position, was tested for its selectivity when located at the F2 position. Accordingly, two ZFPs, one containing QSGSLTR (SEQ ID NO:342) at finger 2 and one containing QSGDLTR (SEQ ID NO:220) at finger 2 (both having identical F1 sequences and identical F3 sequences) were tested by site selection. The results indicated that, when used at the F2 position, QSGSLTR (SEQ ID NO:342) bound preferentially to GTA, rather than GCA. Thus, for optimal binding of a GCA triplet subsite from the F1 position, the amino acid sequence QSGSLTR (SEQ ID NO:342) is required; while, for optimal binding of the same subsite sequence from F2 or F3, QSGDLTR (SEQ ID NO:220) should be used. Accordingly, different zinc finger amino acid sequences may be needed to specify a particular triplet subsite sequence, depending upon the location of the subsite within the target sequence and, hence, upon the position of the finger in the protein.

Positional effects were also observed for zinc fingers recognizing GAT and GGT subsites. The zinc finger amino acid sequence QSSNLAR (SEQ ID NO:1765) (−1 through +6) is expected to bind to GAT, based on design rules. However, this sequence selected GAT only from the F1 position, and not from the F2 and F3 positions, from which the sequence GAA was preferentially bound (FIG. 3B). Similarly, the amino acid sequence QSSHLTR (SEQ ID NO:835) which, based on design rules, should bind GGT, selected GGT at the F1 position, but not at the F2 and F3 positions, from which it preferentially bound GGA (FIG. 3C). Conversely, the amino acid sequence TSGHLVR (SEQ ID NO:1425) has previously been disclosed to recognize the triplet GGT, based on its selection from a randomized library of zif268 finger 2. U.S. Pat. No. 6,140,081. However, TSGHLVR (SEQ ID NO:1425) was not specific for the GGT subsite when located at the F1 position (FIG. 3C). These results indicate that the binding specificity of many fingers is position dependent, and particularly point out that the sequence specificity of a zinc finger selected from a F2 library may be positionally limited.

The results shown in FIG. 2 indicate that recognition of at least GAA and GCC triplets by zinc fingers is also position dependent.

These positional dependences stand in contrast to earlier published work, which suggested that zinc fingers behaved as independent modules with respect to the sequence specificity of their binding to DNA. Desjarlais et al. (1993) *Proc. Natl. Acad. Sci. USA* 90:2256-2260.

Example 5

Characterization of EP2C

The engineered zinc finger protein EP2C binds to a target sequence, GCGGTGGCT with a dissociation constant ($K_d$) of 2 nM. Site selection results indicated that fingers 1 and 2 are highly specific for their target subsites, while finger 3 selects GCG (its intended target subsite) and GTG at approximately equal frequencies (FIG. 4A). To confirm these observations, the binding affinities of EP2C to its cognate target sequence, and to variant target sequences, was measured by standard gel-shift analyses (see Example 1, supra). As standards for comparison, the binding affinities of Sp1 and zif268 to their respective targets were also measured under the same conditions, and were determined to be 40 nM for SP1 (target sequence GGGGCGGGG) and 2 nM for zif268 (target sequence GCGTGGGCG). Measurements of binding affinities confirmed that F3 of EP2C bound GTG and GCG equally well ($K_d$s of 2 nM), but bound GAG with a two-fold lower affinity (FIG. 4B). Finger 2 was very specific for the GTG triplet, binding 15-fold less tightly to a GGG triplet (compare 2C0 and 2C3 in FIG. 4B). Finger 1 was also very specific for the GCT triplet, it bound with 4-fold lower affinity to a GAT triplet (2C4) and with 2-fold lower affinity to a GCG triplet (2C5). This example shows, once again, the high degree of correlation between site selection results and binding affinities.

Example 6

Evaluation of Engineered ZFPs by In Vivo Functional Assays

To determine whether a correlation exists between the binding affinity of a engineered ZFP to its target sequence and its functionality in vivo, cell-based reporter gene assays were used to analyze the functional properties of the engineered ZFP EP2C (see Example 5, supra). For these assays, a plasmid encoding the EP2C ZFP, fused to a VP16 transcriptional activation domain, was used to construct a stable cell line (T-Rex-293™, Invitrogen, Carlsbad, Calif.) in which expression of EP2C-VP16 is inducible, as described in Zhang et al., supra. To generate reporter constructs, three tandem copies of the EP2C target site, or its variants (see FIG. 4B, column 2), were inserted between the Mlu I and BglII sites of the pGL3 luciferase-encoding vector (Promega, Madison, Wis.), upstream of the SV40 promoter. Structures of all reporter constructs were confirmed by DNA sequencing.

Luciferase reporter assays were performed by co-transfection of luciferase reporter construct (200 ng) and pCMV-βgal (100 ng, used as an internal control) into the EP2C cells seeded in 6-well plates. Expression of the EP2C-VP16 transcriptional activator was induced with doxycycline (0.05 ug/ml) 24 h after transfection of reporter constructs. Cell lysates were harvested 40 hours post-transfection, luciferase and β-galactosidase activities were measured by the Dual-Light Reporter Assay System (Tropix, Bedford, Mass.), and luciferase activities were normalized to the co-transfected β-galactosidase activities. The results, shown on the right side of FIG. 4B, showed that the normalized luciferase activity for each reporter construct was well correlated with the in vitro binding affinity of EP2C to the target sequence present in the construct. For example, the target sequences to which EP2C bound with greatest affinity (2C0 and 2C2, $K_d$ of 2 nM for each) both stimulated the highest levels of luciferase activity, when used to drive luciferase expression in the reporter construct (FIG. 4B). Target sequences to which EP2C bound with 2-fold lower affinity, 2C1 and 2C5 ($K_d$ of 4 nM for each), stimulated roughly half the luciferase activity of the 2C0 and 2C2 targets. The 2C3 and 2C4 sequences, for which EP2C showed the lowest in vitro binding affinities, also yielded the lowest levels of in vivo activity when used to drive luciferase expression. Target 3B, a sequence to which EP2C does not bind, yielded background levels of luciferase activity, similar to those obtained with a luciferase-encoding vector lacking EP2C target sequences (pGL3). Thus there exist good correlations between binding affinity (as determined by $K_d$ measurement), binding specificity (as determined by site selection) and in vivo functionality for engineered zinc finger proteins.

TABLE 1

| SBS# | TARGET | SEQ ID | F1 | SEQ ID | F2 | SEQ ID | F3 | SEQ ID | Kd (nM) |
|---|---|---|---|---|---|---|---|---|---|
| 249 | GCGGGGGCG | 17 | RSDELTR | 123 | RSDHLSR | 229 | RSDELRR | 335 | 20 |
| 250 | GCGGGGGCG | 18 | RSDELTR | 124 | RSDHLSR | 230 | RSDTLKK | 336 | 70 |
| 251 | GCGGAGGCG | 19 | RSDELTR | 125 | RSDNLTR | 231 | RSDELRR | 337 | 27.5 |
| 252 | GCGGCCGCG | 20 | RSDELTR | 126 | DRSSLTR | 232 | RSDELRR | 338 | 100 |
| 253 | GGATGGGGG | 21 | RSDHLAR | 127 | RSDHLTT | 233 | QPAHLAR | 339 | 0.75 |
| 256 | GCGGGGTCC | 22 | ERGDLTT | 128 | RSDHLSR | 234 | RSDELRR | 340 | 800 |
| 258 | GCGGGCGGG | 23 | RSDHLTR | 129 | ERGHLTR | 235 | RSDELRR | 341 | 15 |
| 259 | GCAGAGGAG | 24 | RSDNLAR | 130 | RSDNLAR | 236 | QSGSLTR | 342 | 250 |
| 261 | GAGGTGGCC | 25 | ERGTLAR | 131 | RSDALSR | 237 | RSDNLSR | 343 | 0.5 |
| 262 | GCGGGGGCT | 26 | QSSDLQR | 132 | RSDHLSR | 238 | RSDELRR | 344 | 20 |
| 263 | GCGGGGGCT | 27 | QSSDLQR | 133 | RSDHLSR | 239 | RSDTLKK | 345 | 1 |
| 264 | GTGGCTGCC | 28 | DRSSLTR | 134 | QSSDLQR | 240 | RSDALAR | 346 | 27 |
| 265 | GTGGCTGCC | 29 | ERGTLAR | 135 | QSSDLQR | 241 | RSDALAR | 347 | 600 |
| 269 | GGGGCCGGG | 30 | RSDHLTR | 136 | DRSSLTR | 242 | RSDHLTR | 348 | 5 |
| 270 | GGGGCCGGG | 31 | RSDHLTR | 137 | ERGTLAR | 243 | RSDHLTR | 349 | 52.5 |
| 272 | GCAGGGGCC | 32 | DRSSLTR | 138 | RSDHLSR | 244 | QSGSLTR | 350 | 20 |
| 337 | TGCGGGGCAA | 33 | RSADLTR | 139 | RSDHLTR | 245 | ERQHLAT | 351 | 24 |
| 338 | TGCGGGGCAA | 34 | RSADLTR | 140 | RSDHLTR | 246 | ERDHLRT | 352 | 8 |
| 339 | TGCGGGGCAA | 35 | RSADLTR | 141 | RSDHLTT | 247 | ERQHLAT | 353 | 64 |
| 340 | TGCGGGGCAA | 36 | RSADLTR | 142 | RSDHLTT | 248 | ERDHLRT | 354 | 48 |
| 341 | TGCGGGGCAA | 37 | RSADLTR | 143 | RGDHLKD | 249 | ERQHLAT | 355 | 1000 |
| 342 | TGCGGGGCAA | 38 | RSADLTR | 144 | RGDHLKD | 250 | ERDHLRT | 356 | 1000 |
| 343 | TGCGGGGCAA | 39 | QSGSLTR | 145 | RSDHLTR | 251 | ERQHLAT | 357 | 8 |
| 344 | TGCGGGGCAA | 40 | QSGSLTR | 146 | RSDHLTR | 252 | ERDHLRT | 358 | 6 |
| 345 | TGCGGGGCAA | 41 | QSGSLTR | 147 | RSDHLTT | 253 | ERQHLAT | 359 | 96 |
| 346 | TGCGGGGCAA | 42 | QSGSLTR | 148 | RSDHLTT | 254 | ERDHLRT | 360 | 64 |
| 347 | TGCGGGGCAA | 43 | QSGSLTR | 149 | RGDHLKD | 255 | ERQHLAT | 361 | 1000 |
| 348 | TGCGGGGCAA | 44 | QSGSLTR | 150 | RGDHLKD | 256 | ERDHLRT | 362 | 1000 |
| 367 | GGGGCGGG | 45 | RSDHLTR | 151 | DSGHLTR | 257 | RSDHLQR | 363 | 60 |
| 368 | GAGGGGGCG | 46 | RSDELTR | 152 | RSDHLTR | 258 | RSDNLTR | 364 | 3.5 |
| 369 | GTAGTTGTG | 47 | RSDALTR | 153 | TGGSLAR | 259 | QSGSLTR | 365 | 95 |

TABLE 1-continued

| SBS# | TARGET | SEQ ID F1 | SEQ ID F2 | SEQ ID F3 | SEQ ID | Kd (nM) |
|---|---|---|---|---|---|---|
| 370 | GTAGTTGTG | 48 RSDALTR | 154 NRATLAR | 260 QSASLTR | 366 | 300 |
| 371 | GTAGTTGTG | 49 RSDALTR | 155 NRATLAR | 261 QSGSLTR | 367 | 175 |
| 372 | GTAGTTGTG | 50 RSDSLLR | 156 TGGSLAR | 262 QSASLTR | 368 | 112.5 |
| 373 | GTAGTTGTG | 51 RSDSLLR | 157 NPATLAR | 263 QSASLTR | 369 | 320 |
| 374 | GCTGAGGAA | 52 QRSNLVR | 158 RSDNLTR | 264 TSSELQR | 370 | 3.3 |
| 375 | GAGGAAGAT | 53 QQSNLAR | 159 QSGNLQR | 265 RSDNLTR | 371 | 85 |
| 401 | GTAGTTGTG | 54 RSDALTR | 160 TGGSLAR | 266 QSASLTR | 372 | 80 |
| 403 | GTAGTTGTG | 55 RSDSLLR | 161 NRATLAR | 267 QSGSLTR | 373 | 750 |
| 421 | GTAGTTGTG | 56 DSDSLLR | 162 TGGSLAR | 268 QSGSLTR | 374 | 500 |
| 422 | GTAGTTGTG | 57 RSDSLLR | 163 TGGSLTR | 269 QSGSLTR | 375 | 200 |
| 423 | GTAGTTGTG | 58 RSDALTR | 164 TGGSLAR | 270 QRSALAR | 376 | 1000 |
| 424 | GATGCTGAG | 59 RSDNLTR | 165 TSSELQR | 271 TSANLSR | 377 | 100 |
| 425 | GATGCTGAG | 60 RSDNLTR | 166 QSSDLQR | 272 QQSNLAR | 378 | 25 |
| 426 | GATGCTGAG | 61 RSDNLTR | 167 QSSDLQR | 273 TSANLSR | 379 | 5.5 |
| 427 | GCTGAGGAA | 62 QRSNLVR | 168 RSDNLTR | 274 QSSDLQR | 380 | 1 |
| 428 | GAAGATGAC | 63 DSSNLTR | 169 QQSNLAR | 275 QRSNLVR | 381 | 120 |
| 429 | GAAGATGAC | 64 DSSNLTR | 170 TSANLSR | 276 QRSNLVR | 382 | 50 |
| 430 | GATGACGAC | 65 EKANLTR | 171 DSSNLTR | 277 QQSNLAR | 383 | 250 |
| 431 | GACGACGGC | 66 DSGHLTR | 172 DRSNLER | 278 DSSNLTR | 384 | 100 |
| 432 | GACGACGGC | 67 DSGHLTR | 173 DHANLAR | 279 DSSNLTR | 385 | 1000 |
| 433 | GACGACGGC | 68 DSGNLTR | 174 DHANLAR | 280 DSSNLTR | 386 | 1000 |
| 434 | GACGGCGTA | 69 QSASLTR | 175 DSGHLTR | 281 EKANLTR | 387 | 152.5 |
| 435 | GACGGCGTA | 70 QSASLTR | 176 DSGHLTR | 282 ERGNLTR | 388 | 150 |
| 436 | GACGGCGTA | 71 QRSALAR | 177 DSGHLTR | 283 EKANLTR | 389 | 95 |
| 437 | GACGGCGTA | 72 QRSALAR | 178 DSGHLTR | 284 ERGNLTR | 390 | 117.5 |
| 438 | GAGGGGGCG | 73 RSDELTR | 179 RSDHLTT | 285 RSDNLTR | 391 | 62.5 |
| 440 | GCCGAGGTGC | 74 RSDSLLR | 180 RSKNLQR | 286 ERGTLAR | 392 | 40 |
| 441 | GGTGGAGTCA | 75 DSGSLTR | 181 QSGHLQR | 287 TSGHLTR | 393 | 250 |
| 445 | GTCGCAGTGA | 76 RSDSLRR | 182 QSSDLQK | 288 DSGSLTR | 394 | 1000 |
| 450 | GACTTGGTGC | 77 RSDTLAR | 183 RGDALTS | 289 DRSNLTR | 395 | 130 |
| 453 | GGTGGAGTCA | 78 DRSALAR | 184 QSGHLQR | 290 DSSKLSR | 396 | 150 |
| 461 | GAGTACTGTA | 79 QRSHLTT | 185 DRSNLRT | 291 RSDNLAR | 397 | 120 |
| 463 | GTGGAGGAGA | 80 RSDNLTR | 186 RSDNLAR | 292 RSDALAR | 398 | 0.5 |
| 464 | GTGGAGGAGA | 81 RSDNLTR | 187 RSDNLAR | 293 RSDSLAR | 399 | 0.4 |
| 466 | CAGGCTGCGC | 82 RSDDLTR | 188 QSSDLQR | 294 RSDNLRE | 400 | 65 |
| 467 | CAGGCTGCGC | 83 RSDELTR | 189 QSSDLQR | 295 RGDHLKD | 401 | 800 |
| 468 | CAGGCTGCGC | 84 RSDDLTR | 190 QSSDLQR | 296 RGDHLKD | 402 | 42 |
| 469 | GAAGAGGTCT | 85 DRSALAR | 191 RSDNLAR | 297 QSGNLTR | 403 | 13.5 |

TABLE 1-continued

| SBS# | TARGET | SEQ ID F1 | SEQ ID F2 | SEQ ID F3 | SEQ ID | Kd (nM) |
|---|---|---|---|---|---|---|
| 472 | GAGGTCTGGA | 86 RSSHLTT | 192 DRSALAR | 298 RSDNLAR | 404 | 80 |
| 476 | GGAGAGGATG | 87 TTSNLRR | 193 RSDNLAR | 299 QSDHLTR | 405 | 80 |
| 477 | GGAGAGGATG | 88 TTSNLRR | 194 RSDNLAR | 300 QRAHLAR | 406 | 100 |
| 478 | GGAGAGGATG | 89 TTSNLRR | 195 RSDNLAR | 301 QSGHLRR | 407 | 60 |
| 479 | GTGGCGGACC | 90 DSSNLTR | 196 RSDELQR | 302 RSDALAR | 408 | 8.5 |
| 480 | GTGGCGGACC | 91 DSSNLTR | 197 RADTLRR | 303 RSDALAR | 409 | 5 |
| 483 | GAGGGCGAAG | 92 QSANLAR | 198 ESSKLKR | 304 RSDNLAR | 410 | 130 |
| 484 | GAGGGCGAAG | 93 QSDNLAR | 199 ESSKLKR | 305 RSDNLAR | 411 | 1000 |
| 485 | GGAGAGGTTT | 94 QSSALAR | 200 RSDNLAR | 306 QRAHLAR | 412 | 110 |
| 487 | GGAGAGGTTT | 95 NRATLAR | 201 RSDNLAR | 307 QSGHLAR | 413 | 76.9 |
| 488 | TGGTAGGGGG | 96 RSDHLAR | 202 RSDNLTT | 308 RSDHLTT | 414 | 35 |
| 490 | TAGGGGGTGG | 97 RSDSLLR | 203 RSDHLTR | 309 RSDNLTT | 415 | 1.5 |
| 503 | GCCGAGGTGC | 98 RSDSLLR | 204 RSDNLAR | 310 ERGTLAR | 416 | 50 |
| 504 | GCCGAGGTGC | 99 RSDSLLR | 205 RSDNLAR | 311 DRSDLTR | 417 | 25 |
| 505 | GCCGAGGTGC | 100 RSDSLLR | 206 RSDNLAR | 312 DCRDLAR | 418 | 65 |
| 526 | GCGGGCGGGC | 101 RSDHLTR | 207 ERGHLTR | 313 RSDTLKK | 419 | 8 |
| 543 | GAGTGTGTGA | 102 RSDLLQR | 208 MSHHLKE | 314 RSDHLSR | 420 | 50 |
| 544 | GAGTGTGTGA | 103 RSDSLLR | 209 MSHHLKE | 315 RSDNLAR | 421 | 125 |
| 545 | GAGTGTGTGA | 104 RKDSLVR | 210 TSDHLAS | 316 RSDNLTR | 422 | 32 |
| 546 | GAGTGTGTGA | 105 RSDLLQR | 211 MSHHLKT | 317 RLDGLRT | 423 | 500 |
| 547 | GAGTGTGTGA | 106 RKDSLVR | 212 TSGHLTS | 318 RSDNLTR | 424 | 500 |
| 548 | GAGTGTGTGA | 107 RSSLLQR | 213 MSHHLKT | 319 RSDHLSR | 425 | 500 |
| 549 | GAGTGTGTGA | 108 RSSLLQR | 214 MSHHLKE | 320 RSDHLSR | 426 | 500 |
| 550 | GAGTGTGTGA | 109 RKDSLVR | 215 TKDHLAS | 321 RSDNLTR | 427 | 20 |
| 551 | GAGTGTGTGA | 110 RSDLLQR | 216 MSHHLKT | 322 RSDHLSR | 428 | 50 |
| 552 | GAGTGTGTGA | 111 RKDSLVR | 217 MSHHLKT | 323 RSDNLTR | 429 | 31 |
| 553 | GAGTGTGTGA | 112 RSDSLLR | 218 MSHHLKE | 324 RSDNLTR | 430 | 125 |
| 554 | GAGTGTGTGA | 113 RKDSLVR | 219 TSDHLAS | 325 RSDNLAR | 431 | 62.5 |
| 558 | TGCGGGGCA | 114 QSGDLTR | 220 RSDHLTR | 326 DSGHLAS | 432 | 21 |
| 559 | GAGTGTGTGA | 115 RSDSLLR | 221 TSDHLAS | 327 RSDNLAR | 433 | 1000 |
| 560 | GAGTGTGTGA | 116 RSSLLQR | 222 MSHHLKT | 328 RSDHLSR | 434 | 500 |
| 561 | GAGTGTGTGA | 117 RKDSLVR | 223 MSHHLKE | 329 RSDNLAR | 435 | 1000 |
| 562 | GAGTGTGTGA | 118 RSDSLLR | 224 TSGHLTS | 330 RSDNLAR | 436 | 1000 |
| 565 | GATGCTGAG | 119 RSDNLTR | 225 TSSELQR | 331 QQSNLAR | 437 | 100 |
| 567 | GAAGATGAC | 120 EKANLTR | 226 TSANLSR | 332 QRSNLVR | 438 | 47.5 |
| 568 | GATGACGAC | 121 EKAIThTR | 227 DSSNLTR | 333 TSANLSR | 439 | 300 |
| 569 | GTAGTTGTG | 122 RSDSLLR | 228 TGGSLAR | 334 QRSALTR | 440 | 52 |

TABLE 2

| SBS# | TARGET | SEQ ID | F1 | SEQ ID | F2 | SEQ ID | F3 | SEQ ID | Kd (nM) |
|---|---|---|---|---|---|---|---|---|---|
| 201 | GCAGCCTTG | 441 | RSDSLTS | 646 | ERSTLTR | 851 | QRADLRR | 1056 | 1000 |
| 202 | GCAGCCTTG | 442 | RSDSLTS | 647 | ERSTLTR | 852 | QRADLAR | 1057 | 1000 |
| 203 | GCAGCCTTG | 443 | RSDSLTS | 648 | ERSTLTR | 853 | QPATLRR | 1058 | 1000 |
| 204 | GCAGCCTTG | 444 | RSDSLTS | 649 | ERSTLTR | 854 | QRATLAR | 1059 | 1000 |
| 205 | GAGGTAGAA | 445 | QSANLAR | 650 | QSATLAR | 855 | RSDNLSR | 1060 | 80 |
| 206 | GAGGTAGAA | 446 | QSANLAR | 651 | QSAVLAR | 856 | RSDNLSR | 1061 | 1000 |
| 207 | GAGTGGTTA | 447 | QRASLAS | 652 | RSDHLTT | 857 | RSDNLAR | 1062 | 70 |
| 208 | TAGGTCTTA | 448 | QRASLAS | 653 | DRSALAR | 858 | RSDNLAS | 1063 | 1000 |
| 209 | GGAGTGGTT | 449 | QSSALAR | 654 | RSDALAR | 859 | QRAHLAR | 1064 | 35 |
| 210 | GGAGTGGTT | 450 | NRDTLAR | 655 | RSDALAR | 860 | QPAHLAR | 1065 | 65 |
| 211 | GGAGTGGTT | 451 | QSSALAR | 656 | RSDALAS | 861 | QRAHLAR | 1066 | 140 |
| 212 | GGAGTGGTT | 452 | NRDTLAR | 657 | RSDALAS | 862 | QRAHLAR | 1067 | 400 |
| 213 | GTTGCTGGA | 453 | QRAHLAR | 658 | QSSTLAR | 863 | QSSALAR | 1068 | 1000 |
| 214 | GTTGCTGGA | 454 | QRAHLAR | 659 | QSSTLAR | 864 | NRDTLAR | 1069 | 1000 |
| 215 | GAAGTCTGT | 455 | NRDHLMV | 660 | DRSALAR | 865 | QSANLSR | 1070 | 1000 |
| 216 | GAAGTCTGT | 456 | NRDHLTT | 661 | DRSALAR | 866 | QSANLSR | 1071 | 1000 |
| 217 | GAGGTCGTA | 457 | QRSALAR | 662 | DRSALAR | 867 | RSDNLAR | 1072 | 40 |
| 219 | GATGTTGAT | 458 | QQSNLAR | 663 | NRDTLAR | 868 | NRDNLSR | 1073 | 1000 |
| 220 | GATGTTGAT | 459 | QQSNLAR | 664 | NRDTLAR | 869 | QQSNLSR | 1074 | 1000 |
| 221 | GATGAGTAC | 460 | DRSNLRT | 665 | RSDNLAR | 870 | NRDNLAR | 1075 | 1000 |
| 222 | GATGAGTAC | 461 | ERSNLRT | 666 | RSDNLAR | 871 | NRDNLAR | 1076 | 1000 |
| 223 | GATGAGTAC | 462 | DRSNLRT | 667 | RSDNLAR | 872 | QQSNLAR | 1077 | 105 |
| 224 | GATGAGTAC | 463 | ERSNLRT | 668 | RSDNLAR | 873 | QQSNLAR | 1078 | 1000 |
| 225 | TGGGAGGTC | 464 | DRSALAR | 669 | RSDNLAR | 874 | RSDHLTT | 1079 | 6 |
| 226 | GCAGCCTTG | 465 | RGDALTS | 670 | ERGTLAR | 875 | QSGSLTR | 1080 | 1000 |
| 227 | GCAGCCTTG | 466 | RGDALTV | 671 | ERGTLAR | 876 | QSGSLTR | 1081 | 1000 |
| 228 | GCAGCCTTG | 467 | RGDALTM | 672 | ERGTLAR | 877 | QSGSLTR | 1082 | 1000 |
| 229 | GCAGCCTTG | 468 | RGDALTS | 673 | ERGTLAR | 878 | RSDELTR | 1083 | 1000 |
| 230 | GCAGCCTTG | 469 | RGDALTV | 674 | ERGTLAR | 879 | RSDELTR | 1084 | 1000 |
| 231 | GCAGCCTTG | 470 | RGDALTM | 675 | ERGTLAR | 880 | RSDELTR | 1085 | 1000 |
| 232 | GGTGTGGTG | 471 | RSDALTR | 676 | RSDALAR | 881 | NRSHLAR | 1086 | 50 |
| 233 | GGTGTGGTG | 472 | RSDALTR | 677 | RSDALAR | 882 | QASHLAR | 1087 | 100 |
| 235 | GTAGAGGTG | 473 | RSDALTR | 678 | RSDNLAR | 883 | QRGALAR | 1088 | 80 |

TABLE 2-continued

| SBS# | TARGET | SEQ ID | F1 | SEQ ID | F2 | SEQ ID | F3 | SEQ ID | Kd (nM) |
|---|---|---|---|---|---|---|---|---|---|
| 236 | GGGGAGGGG | 474 | RSDHLAR | 679 | RSDNLAR | 884 | RSDHLSR | 1089 | 0.3 |
| 237 | GGGGAGGCC | 475 | ERGTLAR | 680 | RSDNLAR | 885 | RSDHLSR | 1090 | 0.3 |
| 238 | GGGGAGGCC | 476 | ERGTLAR | 681 | RSDNLQR | 886 | RSDHLSR | 1091 | 0.8 |
| 239 | GGCGGGAG | 477 | RSDNLTR | 682 | RSDHLTR | 887 | DRSHLAR | 1092 | 0.4 |
| 240 | GCAGGGGAG | 478 | RSDNLTR | 683 | RSDHLSR | 888 | QSGSLTR | 1093 | 1 |
| 242 | GGGGGTGCT | 479 | QSSDLRR | 684 | QSSHLAR | 889 | RSDHLSR | 1094 | 1 |
| 243 | GTGGGCGCT | 480 | QSSDLRR | 685 | DRSHLAR | 890 | RSDALAR | 1095 | 75 |
| 244 | TAAGAAGGG | 481 | RSDHLAR | 686 | QSGNLTR | 891 | QSGNLRT | 1096 | 100 |
| 245 | TAAGAAGGG | 482 | RSDHLAR | 687 | QSANLTR | 892 | QSGNLRT | 1097 | 235 |
| 246 | GAAGGGGAG | 483 | RSDNLAR | 688 | RSDHLAR | 893 | QSGNLTR | 1098 | 2 |
| 247 | GAAGGGGAG | 484 | RSDNLAR | 689 | RSDHLAR | 894 | QSGNLRR | 1099 | 2 |
| 276 | GCGGCCGCG | 485 | RSDELTR | 690 | ERGTLAR | 895 | RSDERKR | 1100 | 90 |
| 277 | GCGGCCGCG | 486 | RSDELTR | 691 | DRSSLTR | 896 | RSDERKR | 1101 | 107 |
| 278 | GCGGCCGCG | 487 | QSWELTR | 692 | ERGTLAR | 897 | RSDERKR | 1102 | 190 |
| 279 | GCGGCCGCG | 488 | QSWELTR | 693 | DRSSLTR | 898 | RSDERKR | 1103 | 260 |
| 280 | GCGGCCGCG | 489 | QSGSLTR | 694 | ERGTLAR | 899 | RSDERKR | 1104 | 160 |
| 281 | GCGGCCGCG | 490 | QSGSLTR | 695 | DRSSLTR | 900 | RSDERKR | 1105 | 225 |
| 282 | GCAGAAGTG | 491 | RGDALTR | 696 | QSANLTR | 901 | QSADLAR | 1106 | 1000 |
| 283 | GCAGAAGTG | 492 | RSDALTR | 697 | QSGNLTR | 902 | QSGSLTR | 1107 | 2 |
| 284 | GCGGCCGCG | 493 | QSGSLTR | 698 | RSDHLTT | 903 | RSDERKR | 1108 | 1000 |
| 285 | TGTGCGGCC | 494 | ERGTLAR | 699 | RSDELTR | 904 | SRDHLQS | 1109 | 1000 |
| 287 | GCAGAAGCG | 495 | RGPDLAR | 700 | QSANLTR | 905 | QSGSLTR | 1110 | 1000 |
| 288 | GCAGAAGCG | 496 | RGPDLAR | 701 | QSANLTR | 906 | QSGSLTR | 1111 | 1000 |
| 289 | GCAGAAGCG | 497 | RGPDLAR | 702 | QSGNLQR | 907 | QSGSLTR | 1112 | 800 |
| 290 | GCAGAAGCG | 498 | RSDELAR | 703 | QSANLQR | 908 | QSADLAR | 1113 | 1000 |
| 292 | GCAGAAGCG | 499 | RSDELTR | 704 | QSANLQR | 909 | QSGSLTR | 1114 | 1000 |
| 293 | GTGTGCGGC | 500 | DRSHLTR | 705 | ERHSLQT | 910 | RSDALTR | 1115 | 320 |
| 296 | TGCGCGGCC | 501 | ERGTLAR | 706 | RSDELTR | 911 | DRDHLQS | 1116 | 1000 |
| 297 | TGCGCGGCC | 502 | ERGTLAR | 707 | RSDELRR | 912 | DRSHLQT | 1117 | 500 |
| 298 | GCTTAGGCA | 503 | QTGELRR | 708 | RSDNLQK | 913 | TSGDLSR | 1118 | 4000 |
| 299 | GCTTAGGCA | 504 | QTSDLRR | 709 | RSDNLQK | 914 | QSSDLQR | 1119 | 4000 |
| 300 | GCTTAGGCA | 505 | QTADLRR | 710 | RSDNLQR | 915 | QSSDLSR | 1120 | 400 |
| 301 | GCTTAGGCA | 506 | QSADLRR | 711 | RSDNLQT | 916 | QSSDLSR | 1121 | 350 |
| 302 | GCTTAGGCA | 507 | QSGSLTR | 712 | RSDNLQT | 917 | QSSDLSR | 1122 | 75 |

TABLE 2-continued

| SBS# | TARGET | SEQ ID F1 | SEQ ID F2 | SEQ ID F3 | SEQ ID | Kd (nM) |
|---|---|---|---|---|---|---|
| 303 | GCTTAGGCA | 508 QTGSLTR | 713 RSDNLQT | 918 QSSDLSR | 1123 | 135 |
| 304 | GCTTAGGCA | 509 QTADLTR | 714 RSDNLQT | 919 QSSDLSR | 1124 | 230 |
| 305 | GCTTAGGCA | 510 QTGDLTR | 715 RSDNLQT | 920 QSSDLSR | 1125 | 230 |
| 306 | GCTTAGGCA | 511 QTASLTR | 716 RSDNLQT | 921 QSSDLSR | 1126 | 280 |
| 307 | GAAGAAGCG | 512 RSDELRR | 717 QSGNLQR | 922 QSGNLSR | 1127 | 50.5 |
| 308 | GAAGAAGCG | 513 RSDELRR | 718 QSANLQR | 923 QSANLQR | 1128 | 1000 |
| 309 | GGAGATGCC | 514 ERSDLRR | 719 QSSNLQR | 924 QSGHLSR | 1129 | 4000 |
| 310 | GGAGATGCC | 515 DRSDLTR | 720 NRDNLQT | 925 QSGHLSR | 1130 | 1000 |
| 311 | GGAGATGCC | 516 DRSTLTR | 721 NRDNLQR | 926 QSGHLSR | 1131 | 170 |
| 312 | GGAGATGCC | 517 ERGTLAR | 722 NRDNLQR | 927 QSGHLSR | 1132 | 2000 |
| 313 | GGAGATGCC | 518 DRSDLTR | 723 QRSNLQR | 928 QSGHLSR | 1133 | 1000 |
| 314 | GGAGATGCC | 519 DRSSLTR | 724 QSSNLQR | 929 QSGHLSR | 1134 | 117.5 |
| 315 | GGAGATGCC | 520 ERGTLAR | 725 QSSNLQR | 930 QSGHLSR | 1135 | 265 |
| 316 | GGAGATGCC | 521 ERGTLAR | 726 QRDNLQR | 931 QSGHLSR | 1136 | 3000 |
| 318 | TAGGAGATGC | 522 RSDALTS | 727 RSDNLAR | 932 RSDNLAS | 1137 | 100 |
| 319 | GGGGAAGGG | 523 KTSHLRA | 728 QSGNLSR | 933 RSDHLSR | 1138 | 125 |
| 320 | GGGGAAGGG | 524 RSDHLTR | 729 QSGNLSR | 934 RSDHLSR | 1139 | 5 |
| 321 | GGCGGAGAT | 525 TTSNLRR | 730 QSGHLQR | 935 DRSHLTR | 1140 | 200 |
| 323 | GGCGGAGAT | 526 TTSNLRR | 731 QSGHLQR | 936 DRDHLTR | 1141 | 600 |
| 324 | GGCGGAGAT | 527 TTSNLRR | 732 QSGHLQR | 937 DRDHLTR | 1142 | 200 |
| 325 | GTATCTGCT | 528 NSSDLTR | 733 NSDVLTS | 938 QSDVLTR | 1143 | 1000 |
| 326 | GTATCTGTT | 529 NSDALTR | 734 NSDVLTS | 939 QSDVLTR | 1144 | 1000 |
| 327 | TCTGCTGGG | 530 RSDHLTR | 735 NSADLTR | 940 NSDDLTR | 1145 | 1000 |
| 328 | TCTGTTGGG | 531 RSDHLTR | 736 NSSALTS | 941 NSDDLTR | 1146 | 1000 |
| 349 | GGTGTCGCC | 532 DCRDLAR | 737 DSGSLTR | 942 TSGHLTR | 1147 | 1000 |
| 350 | TCCGAGGGT | 533 TSGHLTR | 738 RSDNLTR | 943 DCRDLTT | 1148 | 332 |
| 351 | GCTGGTGTC | 534 DSGSLTR | 739 TSGHLTR | 944 TLHTLTR | 1149 | 1000 |
| 352 | GGAGGGGTG | 535 RSDSLLR | 740 RSDHLTR | 945 QSDHLTR | 1150 | 26 |
| 353 | GTTGGAGCC | 536 DCRDLAR | 741 QSDHLTR | 946 TSGALTR | 1151 | 1000 |
| 354 | GAAGAGGAC | 537 DSSNLTR | 742 RSDNLTR | 947 QRSNLVR | 1152 | 28 |
| 355 | GAAGAGGAC | 538 EKANLTR | 743 RSDNLTR | 948 QRSNLVR | 1153 | 20 |
| 356 | GGCTGGGCG | 539 RSDELRR | 744 RSDHLTK | 949 DSDHLSR | 1154 | 1000 |

TABLE 2-continued

| SBS# | TARGET | SEQ ID F1 | | SEQ ID F2 | | SEQ ID F3 | | SEQ ID | Kd (nM) |
|---|---|---|---|---|---|---|---|---|---|
| 357 | GGCTGGGCG | 540 | RSDELRR | 745 | RSDHLTK | 950 | DSDHLSR | 1155 | 1000 |
| 358 | GGCTGGGCG | 541 | RSDELRR | 746 | RSDHLTK | 951 | DSSHLSR | 1156 | 225 |
| 361 | GGGTTTGGG | 542 | RSDHLTR | 747 | QSSALTR | 952 | RSDHLTR | 1157 | 130 |
| 363 | GGGTTTGGG | 543 | RSDHLTR | 748 | QSSVLTR | 953 | RSDHLTR | 1158 | 200 |
| 364 | GTGTCCGAAG | 544 | RSDNLTR | 749 | DSAVLTT | 954 | RSD-SLTR | 1159 | 1000 |
| 365 | GGTGCTGGT | 545 | QASHLTR | 750 | QASVLTR | 955 | QASHLTR | 1160 | 600 |
| 366 | GAGGGTGCT | 546 | QASVLTR | 751 | QASHLTR | 956 | RSDN-LTR | 1161 | 1000 |
| 367 | GGGGGCGGG | 547 | RSDHLTR | 752 | DSGHLTR | 957 | RSDHLQR | 1162 | 60 |
| 368 | GAGGGGGCG | 548 | RSDELTR | 753 | RSDHLTR | 958 | RSDN-LTR | 1163 | 3.5 |
| 369 | GTAGTTGTG | 549 | RSDALTR | 754 | TGGSLAR | 959 | QSGSLTR | 1164 | 95 |
| 370 | GTAGTTGTG | 550 | RSDALTR | 755 | NRATLAR | 960 | QSASLTR | 1165 | 300 |
| 371 | GTAGTTGTG | 551 | RSDALTR | 756 | NRATLAR | 961 | QSGSLTR | 1166 | 175 |
| 372 | GTAGTTGTG | 552 | RSDSLLR | 757 | TGGSLAR | 962 | QSASLTR | 1167 | 112.5 |
| 373 | GTAGTTGTG | 553 | RSDSLLR | 758 | NRATLAR | 963 | QSASLTR | 1168 | 320 |
| 374 | GCTGAGGAA | 554 | QRSNLVR | 759 | RSDNLTR | 964 | TSSELQR | 1169 | 3.3 |
| 375 | GAGGAAGAT | 555 | QQSNLAR | 760 | QSGNLQR | 965 | RSDN-LTR | 1170 | 85 |
| 377 | GTGTTGGCAG | 556 | QSGSLTR | 761 | RGDALTS | 966 | RSDALTR | 1171 | 89 |
| 378 | GCCGAGGAGA | 557 | RSDNLTR | 762 | RSDNLTR | 967 | DRSS-LTR | 1172 | 31 |
| 379 | GCCGAGGAGA | 558 | RSDNLTR | 763 | RSDNLTR | 968 | ERGT-LAR | 1173 | 3 |
| 380 | GAGTCGGAAG | 559 | QSANLAR | 764 | RSDELTT | 969 | RSDN-LAR | 1174 | 1000 |
| 381 | GCAGCTGCGC | 560 | RSDELTR | 765 | QSSDLQR | 970 | QSGDLTR | 1175 | 1.5 |
| 383 | TGGTTGGTAT | 561 | QSATLAR | 766 | RGDALTS | 971 | RSDHLTT | 1176 | 1000 |
| 384 | GTGGGCTTCA | 562 | DRSALTT | 767 | DRSHLAR | 972 | RSDALAR | 1177 | 60 |
| 385 | GGGGCGGAGC | 563 | RSDNLTR | 768 | RSDTLKK | 973 | RSDHLSR | 1178 | 1.2 |
| 386 | GGGGCGGAGC | 564 | RSDNLTR | 769 | RSDELQR | 974 | RSDHLSR | 1179 | 0.4 |
| 387 | GGCGAGGCAA | 565 | QSGSLTR | 770 | RSDNLAR | 975 | DRSHLAR | 1180 | 2.5 |
| 388 | GGCGAGGCAA | 566 | QSGDLTR | 771 | RSDNLAR | 976 | DRSHLAR | 1181 | 28 |
| 390 | GTGGCAGCGG | 567 | RSDTLKK | 772 | QSSDLQK | 977 | RSDALAR | 1182 | 20 |
| 392 | GTGGCAGCGG | 568 | RSDELTR | 773 | QSSDLQK | 978 | RSDALAR | 1183 | 1000 |
| 396 | GCGGGAGCAG | 569 | QSGSLTR | 774 | QSGHLQR | 979 | RSDTLKK | 1184 | 18.8 |
| 397 | GCGGGAGCAG | 570 | QSGDLTR | 775 | QSGHLQR | 980 | RSDTLKK | 1185 | 25 |
| 400 | TCAGTGGTGG | 571 | RSDALAR | 776 | RSDSLAR | 981 | QSGDLRT | 1186 | 40 |
| 405 | GCGGCCGCA | 572 | RSDELTR | 777 | ERGTLAR | 982 | RSDERKR | 1187 | 110 |
| 406 | GCGGCCGCA | 573 | RSDELTR | 778 | DRSSLTR | 983 | RSDERKR | 1188 | 110 |
| 407 | GCGGCCGCA | 574 | QSWELTR | 779 | ERGTLAR | 984 | RSDERKR | 1189 | 410 |

TABLE 2-continued

| SBS# | TARGET | SEQ ID | F1 | SEQ ID | F2 | SEQ ID | F3 | SEQ ID | Kd (nM) |
|---|---|---|---|---|---|---|---|---|---|
| 408 | GCGGCCGCA | 575 | QSWELTR | 780 | DRSSLTR | 985 | RSDERKR | 1190 | 380 |
| 409 | GCGGCCGCA | 576 | QSGSLTR | 781 | ERGTLAR | 986 | RSDERKR | 1191 | 50 |
| 410 | GCAGAAGTC | 577 | RSDALTR | 782 | QSGNLTR | 987 | QSGSLTR | 1192 | 3 |
| 411 | GCGGCCGCA | 578 | QSGSLTR | 783 | RSDHLTT | 988 | RSDERKR | 1193 | 1000 |
| 412 | GCGTGGGCG | 579 | QSGSLTR | 784 | RSDHLTT | 989 | RSDERKR | 1194 | 5 |
| 413 | GCGTGGGCA | 580 | QSGSLTR | 785 | RSDHLTT | 990 | RSDERKR | 1195 | 5 |
| 414 | GCAGAAGCA | 581 | RSDELTR | 786 | QSANLQR | 991 | QSGSLTR | 1196 | 1000 |
| 415 | GTGTGCGGA | 582 | DRSHLTR | 787 | ERHSLQT | 992 | RSDALTR | 1197 | 1000 |
| 416 | TGTGCGGCC | 583 | ERGTLAR | 788 | RSDELRR | 993 | DRSHLQT | 1198 | 1000 |
| 493 | GGGGTGGCGG | 584 | RSDTLKK | 789 | RSDSLAR | 994 | RSDHLSR | 1199 | 300 |
| 494 | GCCGAGGAGA | 585 | RSDNLTR | 790 | RSDNLTR | 995 | DRSSLTR | 1200 | 90 |
| 496 | GGTGGTGGC | 586 | DTSHLRR | 791 | TSGHLQR | 996 | TSGHLSR | 1201 | 1000 |
| 497 | GTTTGCGTC | 587 | ETASLRR | 792 | DSAHLQR | 997 | TSSALSR | 1202 | 1000 |
| 498 | GAAGAGGCA | 588 | QTGELRR | 793 | RSDNLQR | 998 | QSGNLSR | 1203 | 30 |
| 499 | GCTTGTGAG | 589 | RTSNLRR | 794 | TSSHLQK | 999 | DTDHLRR | 1204 | 1000 |
| 500 | GCTTGTGAG | 590 | RSDNLTR | 795 | QSSNLQT | 1000 | DRSHLAR | 1205 | 1000 |
| 501 | GTGGGGGTT | 591 | NRATLAR | 796 | RSDHLSR | 1001 | RSDALAR | 1206 | 8 |
| 502 | GGGGTGGGA | 592 | QSAHLAR | 797 | RSDALAR | 1002 | RSDHLSR | 1207 | 60 |
| 507 | GAGGTAGAGG | 593 | RSDNLAR | 798 | QRSALAR | 1003 | RSDNLAR | 1208 | 10 |
| 508 | GAGGTAGAGG | 594 | RSDNLAR | 799 | QSATLAR | 1004 | RSDNLAR | 1209 | 10 |
| 509 | GTCGTGTGGC | 595 | RSDHLTT | 800 | RSDALAR | 1005 | DRSALAR | 1210 | 100 |
| 510 | GTTGAGGAAG | 596 | QSGNLAR | 801 | RSDNLAR | 1006 | NPATLAR | 1211 | 100 |
| 511 | GTTGAGGAAG | 597 | QSGNLAR | 802 | RSDNLAR | 1007 | QSSALAR | 1212 | 100 |
| 512 | GAGGTGGAAG | 598 | QSGNLAR | 803 | RSDALAR | 1008 | RSDNLAR | 1213 | 10 |
| 513 | GAGGTGGAAG | 599 | QSANLAR | 804 | RSDALAR | 1009 | RSDNLAR | 1214 | 1.5 |
| 514 | TAGGTGGTGG | 600 | RSDALTR | 805 | RSDALAR | 1010 | RSDNLTT | 1215 | 10 |
| 515 | TGGGAGGAGT | 601 | RSDNLTR | 806 | RSDNLTR | 1011 | RSDHLTT | 1216 | 0.5 |
| 516 | GGAGGAGCT | 602 | TTSELRR | 807 | QSGHLQR | 1012 | QSGHLSR | 1217 | 700 |
| 517 | GGAGCTGGGG | 603 | RTDHLRR | 808 | TSSELQR | 1013 | QSGHLSR | 1218 | 50 |
| 518 | GGGGGAGGAG | 604 | QTGHLRR | 809 | QSGHLQR | 1014 | RSDHLSR | 1219 | 30 |
| 519 | GGGGAGGAGA | 605 | RSDNLAR | 810 | RSDNLSR | 1015 | RSDHLSR | 1220 | 0.3 |
| 520 | GGAGGAGAT | 606 | TTANLRR | 811 | QSGHLQR | 1016 | QSGHLSR | 1221 | 300 |
| 521 | GCAGCAGGA | 607 | QTGHLRR | 812 | QSGELQR | 1017 | QSGELSR | 1222 | 1000 |
| 522 | GATGAGGCA | 608 | QTGELRR | 813 | RSDNLQR | 1018 | TSANLSR | 1223 | 200 |
| 527 | GGGGAGGATC | 609 | TTSNLRR | 814 | RSSNLQR | 1019 | RSDHLSR | 1224 | 2 |

TABLE 2-continued

| SBS# | TARGET | SEQ ID | F1 | SEQ ID | F2 | SEQ ID | F3 | SEQ ID | Kd (nM) |
|---|---|---|---|---|---|---|---|---|---|
| 528 | GGGGAGGATC | 610 | TTSNLRR | 815 | RSSNLQR | 1020 | RSDHLSR | 1225 | 10 |
| 529 | GAGGCTTGGG | 611 | RTDHLRK | 816 | TSAELQR | 1021 | RSSNLSR | 1226 | 1000 |
| 531 | GCGGAGGCTT | 612 | TTGELRR | 817 | RSSNLQR | 1022 | RSDELSR | 1227 | 160 |
| 532 | GCGGAGGCTT | 613 | QSSDLQR | 818 | RSSNLQR | 1023 | RSDELSR | 1228 | 100 |
| 533 | GCGGAGGCTT | 614 | QSSDLQR | 819 | RSDNLAR | 1024 | RSADLSR | 1229 | 7 |
| 534 | GCGGAGGCTT | 615 | QSSDLQR | 820 | RSDNLAR | 1025 | RSDDLRR | 1230 | 10 |
| 535 | GCAGCCGGG | 616 | RTDHLRR | 821 | ESSDLQR | 1026 | QSGELSR | 1231 | 1000 |
| 538 | GCAGAGGCTT | 617 | QSSDLQR | 822 | RSDNLAR | 1027 | QSGSLTR | 1232 | 70 |
| 540 | TGGGCAGGCC | 618 | DRSHLTR | 823 | QSGSLTR | 1028 | RSDHLTT | 1233 | 55 |
| 541 | GGGGAGGAT | 619 | TTSNLRR | 824 | RSSNLQR | 1029 | RSDHLSR | 1234 | 3 |
| 570 | GGGGAAGGCT | 620 | DSGHLTR | 825 | QRSNLVR | 1030 | RSDHLTR | 1235 | 20 |
| 571 | GTGTGTGTGT | 621 | RSDSLTR | 826 | QRSNLVR | 1031 | RSDSLLR | 1236 | 1000 |
| 572 | GCATACGTGG | 622 | RSDSLLR | 827 | DKGNLQS | 1032 | QSDDLTR | 1237 | 1000 |
| 573 | GCATACGTG | 623 | RSDSLLR | 828 | DKGNLQS | 1033 | QSGDLTR | 1238 | 1000 |
| 574 | TACGTGGGGT | 624 | RSDHLTR | 829 | RSDHLTR | 1034 | DKGNLQT | 1239 | 25 |
| 575 | TACGTGGGCT | 625 | DFSHLTR | 830 | RSDHLTR | 1035 | DKGNLQT | 1240 | 472 |
| 576 | GAGGGTGTTG | 626 | NSDTLAR | 831 | TSGHLTR | 1036 | RSDNLTR | 1241 | 200 |
| 577 | GGAGCGGGGA | 627 | RSDHLSR | 832 | RSDELQR | 1037 | QSDHLTR | 1242 | 200 |
| 579 | GGGGTTGAGG | 628 | RSDNLTR | 833 | NRDTLAR | 1038 | TSGHLTR | 1243 | 200 |
| 580 | GGTGTTGGAG | 629 | QPAHLAR | 834 | NRDTLAR | 1039 | TSGHLTR | 1244 | 1000 |
| 581 | TACGTGGGTT | 630 | QSSHLTR | 835 | RSDSLLR | 1040 | DKGNLQT | 1245 | 382 |
| 583 | GTAGGGGTTG | 631 | NSSALTR | 836 | RSDHLTR | 1041 | QSASLTR | 1246 | 46 |
| 584 | GAAGGCGGAG | 632 | QAGHLTR | 837 | DKSHLTR | 1042 | QSGNLTR | 1247 | 1000 |
| 585 | GAAGGCGGAG | 633 | QAGHLTR | 838 | DSGHLTR | 1043 | QSGNLTR | 1248 | 1000 |
| 587 | GGGGGTTACG | 634 | DKGNLQT | 839 | TSGHLTR | 1044 | RSDHLSK | 1249 | 500 |
| 588 | GGGGGGGGGG | 635 | RSDHLSR | 840 | RSDHLTR | 1045 | RSDHLSK | 1250 | 30 |
| 589 | GGAGTATGCT | 636 | DSGHLAS | 841 | QSATLAR | 1046 | QSDHLTR | 1251 | 1000 |
| 595 | TGGTTGGTAT | 637 | QRGSLAR | 842 | RGDALTR | 1047 | RSDHLTT | 1252 | 73.3 |
| 597 | TGGTTGGTA | 638 | QNSAMRK | 843 | RGDALTS | 1048 | RSDHLTT | 1253 | 1000 |
| 598 | TGGTTGGTA | 639 | QRGSLAR | 844 | RDGSLTS | 1049 | RSDHLTT | 1254 | 1000 |
| 599 | TGGTTGGTA | 640 | QNSAMRK | 845 | RDGSLTS | 1050 | RSDHLTT | 1255 | 1000 |
| 600 | GAGTCGGAA | 641 | QSANLAR | 846 | RSDELRT | 1051 | RSDNLAR | 1256 | 206.7 |
| 601 | GAGTCGGAA | 642 | RSANLTR | 847 | RLDGLRT | 1052 | RSDNLAR | 1257 | 606.7 |

TABLE 2-continued

| SBS# | TARGET | SEQ ID F1 | | SEQ ID F2 | | SEQ ID F3 | | SEQ ID | Kd (nM) |
|---|---|---|---|---|---|---|---|---|---|
| 602 | GAGTCGGAA | 643 | RSANLTR | 848 | RQDTLVG | 1053 | RSDNLAR | 1258 | 616.7 |
| 603 | GAGTCGGAA | 644 | QSGNLAR | 849 | RSDELRT | 1054 | RSDNLAR | 1259 | 166.7 |
| 606 | GGGGAGGATC | 645 | TTSNLRR | 850 | RSDNLQR | 1055 | RSDHLSR | 1260 | 0.2 |

TABLE 3

| SBS# | TARGET | SEQ ID F1 | | SEQ ID F2 | | SEQ ID F3 | | SEQ ID | Kd (nM) |
|---|---|---|---|---|---|---|---|---|---|
| 897 | GAGGAGGTGA | 1261 | RSDALAR | 1347 | RSDNLAR | 1433 | RSDNLVR | 1519 | 0.07 |
| 828 | GCGGAGGACC | 1262 | EKANLTR | 1348 | RSDNLAR | 1434 | RSDERKR | 1520 | 0.1 |
| 884 | GAGGAGGTGA | 1263 | RSDSLTR | 1349 | RSDNLAR | 1435 | RSDNLVR | 1521 | 0.15 |
| 817 | GAGGAGGTGA | 1264 | RSDSLTR | 1350 | RSDNLQR | 1436 | RSDNLAR | 1522 | 0.31 |
| 666 | GCGGAGGCGC | 1265 | RSDDLTR | 1351 | RSDNLTR | 1437 | RSDTLKK | 1523 | 0.5 |
| 829 | GCGGAGGACC | 1266 | EKANLTR | 1352 | RSDNLAR | 1438 | RSDTLKK | 1524 | 0.52 |
| 670 | GACGTGGAGG | 1267 | RSDNLAR | 1353 | RSDALAR | 1439 | DRSNLTR | 1525 | 0.57 |
| 801 | AAGGAGTCGC | 1268 | RSADLRT | 1354 | RSDNLAR | 1440 | RSDNLTQ | 1526 | 0.85 |
| 668 | GTGGAGGCCA | 1269 | ERGTLAR | 1355 | RSDNLAR | 1441 | RSDALAR | 1527 | 1.13 |
| 895 | ATGGATTCAG | 1270 | QSHDLTK | 1356 | TSGNLVR | 1442 | RSDALTQ | 1528 | 1.4 |
| 799 | GGGGGAGCTG | 1271 | QSSDLQR | 1357 | QRAHLER | 1443 | RSDHLSR | 1529 | 1.85 |
| 798 | GGGGGAGCTG | 1272 | QSSDLQR | 1358 | QSGHLQR | 1444 | RSDHLSR | 1530 | 3 |
| 842 | GAGGTGGGCT | 1273 | DRSHLTR | 1359 | RSDALAR | 1445 | RSDNLAR | 1531 | 5.4 |
| 894 | TCAGTGGTAT | 1274 | QRSALAR | 1360 | RSDALSR | 1446 | QSHDLTK | 1532 | 6.15 |
| 892 | ATGGATTCAG | 1275 | QSHDLTK | 1361 | QQSNLVR | 1447 | RSDALTQ | 1533 | 6.2 |
| 888 | TCAGTGGTAT | 1276 | QSSSLVR | 1362 | RSDALSR | 1448 | QSHDLTK | 1534 | 14 |
| 739 | GCGGGCGGGC | 1277 | RSDHLTR | 1363 | ERGHLTR | 1449 | RSDDLRR | 1535 | 16.5 |
| 850 | CAGGCTGTGG | 1278 | RSDALTR | 1364 | QSSDLTR | 1450 | RSDNLRE | 1536 | 17 |
| 797 | GCAGAGGCTG | 1279 | QSSDLQR | 1365 | RSDNLAR | 1451 | QSGDLTR | 1537 | 17.5 |
| 891 | TCAGTGGTAT | 1280 | QSSSLVR | 1366 | RSDALSR | 1452 | QSGSLRT | 1538 | 18.5 |
| 887 | TCAGTGGTAT | 1281 | QRSALAR | 1367 | RSDALSR | 1453 | QSGDLRT | 1539 | 23.75 |
| 672 | TCGGACGTGG | 1282 | RSDALAR | 1368 | DRSNLTR | 1454 | RSDELRT | 1540 | 24 |
| 836 | GGGGAGGCCC | 1283 | ERGTLAR | 1369 | RSDNLAR | 1455 | RSDHLSR | 1541 | 24.25 |
| 674 | GCGGCGTCGG | 1284 | RSDELRT | 1370 | RADTLRR | 1456 | RSDTLKK | 1542 | 27.5 |
| 849 | GGGGCCCTGG | 1285 | RSDALRE | 1371 | DRSSLTR | 1457 | RSDHLTQ | 1543 | 29.05 |
| 825 | GAATGGGCAG | 1286 | QSGSLTR | 1372 | RSDHLTT | 1458 | QSGNLTR | 1544 | 37.3 |
| 673 | GCGGGTGTCT | 1287 | DRSALAR | 1373 | QSSHLAR | 1459 | RSDTLKK | 1545 | 48.33 |
| 848 | GGGGAGGCCC | 1288 | DRSSLTR | 1374 | RSDNLAR | 1460 | RSDHLSR | 1546 | 49.5 |
| 662 | AGAGCGGCAC | 1289 | QTGSLTR | 1375 | RSDELQR | 1461 | QSGHLNQ | 1547 | 50 |
| 667 | GAGTCGGACG | 1290 | DRSNLTR | 1376 | RSDELRT | 1462 | RSDNLAR | 1548 | 50 |
| 803 | GCAGCGGCTC | 1291 | QSSDLQR | 1377 | RSDELQR | 1463 | QSGSLTR | 1549 | 57.5 |

TABLE 3-continued

| SBS# | TARGET | SEQ ID F1 | | SEQ ID F2 | | SEQ ID F3 | | SEQ ID | Kd (nM) |
|---|---|---|---|---|---|---|---|---|---|
| 671 | TCGGACGAGT | 1292 | RSDNLAR | 1378 | DRSNLTR | 1464 | RSDELRT | 1550 | 64 |
| 851 | GAGATGGATC | 1293 | QSSNLQR | 1379 | RRDVLMN | 1465 | RLHNLQR | 1551 | 74 |
| 804 | GCAGCGGCTC | 1294 | QSSDLQR | 1380 | RSDDLNR | 1466 | QGSLTR | 1552 | 82.5 |
| 669 | GACGAGTCGG | 1295 | RSDELRT | 1381 | RSDNLAR | 1467 | DRSNLTR | 1553 | 90 |
| 682 | GCTGCAGGAG | 1296 | RSDHLAR | 1382 | QSGDLTR | 1468 | QSSDLSR | 1554 | 90 |
| 845 | GAGATGGATC | 1297 | QSSNLQR | 1383 | RSDALRQ | 1469 | RLHNLQR | 1555 | 112.5 |
| 663 | AGAGCGGCAC | 1298 | QTGSLTR | 1384 | RSDELQR | 1470 | KNWKLQA | 1556 | 115 |
| 738 | GCGGGGTCCG | 1299 | ERGTLTT | 1385 | RSDHLSR | 1471 | RSDDLRR | 1557 | 120 |
| 664 | AGAGCGGCAC | 1300 | QTGSLTR | 1386 | RADTLRR | 1472 | ASSRLAT | 1558 | 125 |
| 833 | GACTAGGACC | 1301 | EKANLTR | 1387 | RSDNLTK | 1473 | DRSNLTR | 1559 | 136 |
| 685 | GCTGCAGGAG | 1302 | RSDHLAR | 1388 | QSGSLTR | 1474 | QSSDLSR | 1560 | 150 |
| 835 | TAGGGAGCGT | 1303 | RADTLRR | 1389 | QSGHLTR | 1475 | RSDNLTT | 1561 | 150 |
| 847 | TAGGGAGCGT | 1304 | RSDDLTR | 1390 | QSGHLTR | 1476 | RSDNLTT | 1562 | 150 |
| 818 | GAATGGGCAG | 1305 | QSGSLTR | 1391 | RSDHLTT | 1477 | QSSNLVR | 1563 | 167 |
| 834 | GACTAGGACC | 1306 | EKANLTR | 1392 | RSDHLTT | 1478 | DRSNLTR | 1564 | 186 |
| 837 | GGGGCCCTGG | 1307 | RSDALRE | 1393 | DRSSLTR | 1479 | RSDHLSR | 1565 | 222 |
| 764 | GCAGAGGCTG | 1308 | TSGELVR | 1394 | RSDNLAR | 1480 | QSGDLTR | 1566 | 255 |
| 774 | GCAGCGGTAG | 1309 | QRSALAR | 1395 | RSDELQR | 1481 | QSGDLTR | 1567 | 258 |
| 765 | GCCGAGGCCG | 1310 | ERGTLAR | 1396 | RSDNLAR | 1482 | ERGTLAR | 1568 | 262.5 |
| 766 | GCCGAGGCCG | 1311 | ERGTLAR | 1397 | RSDNLAR | 1483 | DRSDLTR | 1569 | 262.5 |
| 775 | GCAGCGGTAG | 1312 | QSGALTR | 1398 | RSDELQR | 1484 | QSGDLTR | 1570 | 265 |
| 763 | GCAGAGGCTG | 1313 | TSGELVR | 1399 | RSDNLAR | 1485 | QSGSLTR | 1571 | 275 |
| 838 | GGGGCCCTGG | 1314 | RSDALRE | 1400 | DRSSLTR | 1486 | RSDHLTA | 1572 | 300 |
| 841 | GAGTGTGAGG | 1315 | RSDNLAR | 1401 | QSSHLAS | 1487 | RSDNLAR | 1573 | 300 |
| 770 | TTCGCAGCCT | 1316 | DRSSLTR | 1402 | QSGSLTR | 1488 | RSDSLTK | 1574 | 325 |
| 767 | GGGGGAGCTG | 1317 | QSSDLAR | 1403 | QSGHLQR | 1489 | RSDHLSR | 1575 | 335 |
| 800 | TTGGCAGCCT | 1318 | ERGTLAR | 1404 | QSGSLTR | 1490 | RSDSLTK | 1576 | 400 |
| 832 | GACTAGGACC | 1319 | EKANLTR | 1405 | RSDNLTT | 1491 | DRSNLTR | 1577 | 408 |
| 844 | GAGATGGATC | 1320 | QSSNLQR | 1406 | RSDALRQ | 1492 | RSDNLQR | 1578 | 444 |
| 683 | GCTGCAGGAG | 1321 | QSGHLAR | 1407 | QSGSLTR | 1493 | QSSDLSR | 1579 | 500 |
| 805 | GCAGCGGTAG | 1322 | QRSALAR | 1408 | RSDELQR | 1494 | QSGSLTR | 1580 | 500 |
| 839 | GAGTGTGAGG | 1323 | RSDNLAR | 1409 | TSDHLAS | 1495 | RSDNLAR | 1581 | 625 |
| 840 | GAGTGTGAGG | 1324 | RSDNLAR | 1410 | MSHHLKT | 1496 | RSDNLAR | 1582 | 625 |
| 830 | GGAGAGTCGG | 1325 | RSDELRT | 1411 | RSDNLAR | 1497 | QPAHLAR | 1583 | 683 |
| 831 | GGAGAGTCGG | 1326 | RSDDLTK | 1412 | RSDNLAR | 1498 | QRAHLAR | 1584 | 700 |
| 684 | GCTGCAGGAG | 1327 | RSAHLAR | 1413 | QSGSLTR | 1499 | QSSDLSR | 1585 | 850 |
| 846 | GAGATGGATC | 1328 | QSSNLQR | 1414 | RRDVLNN | 1500 | RSDNLQR | 1586 | 889.5 |
| 819 | AAGTAGGGTG | 1329 | QSSHLTR | 1415 | RSDNLTT | 1501 | RSDNLTQ | 1587 | 1000 |

TABLE 3-continued

| SBS# | TARGET | SEQ ID | F1 | SEQ ID | F2 | SEQ ID | F3 | SEQ ID | Kd (nM) |
|---|---|---|---|---|---|---|---|---|---|
| 820 | ACGGTAGTTA | 1330 | QSSALTR | 1416 | QRSALAR | 1502 | RSDTLTQ | 1588 | 1000 |
| 821 | ACGGTAGTTA | 1331 | NRATLAR | 1417 | QRSALAR | 1503 | RSDTLTQ | 1589 | 1000 |
| 822 | GTGTGCTGGT | 1332 | RSDHLTT | 1418 | ERQHLAT | 1504 | RSDALAR | 1590 | 1000 |
| 823 | GTGTGCTGGT | 1333 | RSDHLTK | 1419 | ERQHLAT | 1505 | RSDALAR | 1591 | 1000 |
| 824 | GTGTGCTGGT | 1334 | RSDHLTT | 1420 | DRSHLRT | 1506 | RSDALAR | 1592 | 1000 |
| 885 | GTGTGCTGGT | 1335 | RSDHLTK | 1421 | DRSHLRT | 1507 | RSDALAR | 1593 | 1000 |
| 886 | TCAGTGGTAT | 1336 | QSSSLVR | 1422 | RSDALSR | 1508 | QSGDLRT | 1594 | 1000 |
| 889 | ATGGATTCAG | 1337 | QSGSLTT | 1423 | QQSNLVR | 1509 | RSDALTQ | 1595 | 1000 |
| 890 | CTGGTATGTC | 1338 | QRSHLTT | 1424 | QRSALAR | 1510 | RSDALRE | 1596 | 1000 |
| 896 | AAGTAGGGTG | 1339 | TSGHLVR | 1425 | RSDNLTT | 1511 | RSDNLTQ | 1597 | 1000 |
| 898 | ACGGTAGTTA | 1340 | NPATLAR | 1426 | QSSSLVR | 1512 | RSDTLTQ | 1598 | 1000 |
| 899 | CTGGTATGTC | 1341 | QRSHLTT | 1427 | QSSSLVR | 1513 | RSDALRE | 1599 | 1000 |
| 900 | CTGGTATGTC | 1342 | MSHHLKE | 1428 | QSSSLVR | 1514 | RSDALRE | 1600 | 1000 |
| 901 | CTGGTATGTC | 1343 | NSHHLKE | 1429 | QRSALAR | 1515 | RSDALRE | 1601 | 1000 |
| 773 | GCAGCGGTAG | 1344 | QSGALTR | 1430 | RSDELQR | 1516 | QSGSLTR | 1602 | 1250 |
| 768 | GGGGGAGCTG | 1345 | QSSDLAR | 1431 | QRAHLER | 1517 | RSDHLSR | 1603 | 2000 |
| 681 | GCTGCAGGAG | 1346 | RSAHLAR | 1432 | QSGDLTR | 1518 | QSSDLSR | 1604 | 3000 |

TABLE 4

| SBS# | TARGET | SEQ ID | F1 | SEQ ID | F2 | SEQ ID | F3 | SEQ ID | Kd (nM) |
|---|---|---|---|---|---|---|---|---|---|
| 607 | AAGGTGGCAG | 1605 | QSGDLTR | 1707 | RSDSLAR | 1809 | RLDNRTA | 1911 | 6.5 |
| 608 | TTGGCTGGGC | 1606 | GSWHLTR | 1708 | QSSDLQR | 1810 | RSDSLTK | 1912 | 8 |
| 611 | GTGGCTGCAG | 1607 | QSGDLTR | 1709 | QSSDLQR | 1811 | RSDALAR | 1913 | 11.5 |
| 612 | GTGGCTGCAG | 1608 | QSGTLTR | 1710 | QSSDLQR | 1812 | RSDALAR | 1914 | 0.38 |
| 613 | TTGGCTGGGC | 1609 | RSDHLAR | 1711 | QSSDLQR | 1813 | RGDALTS | 1915 | 1.45 |
| 614 | TTGGCTGGGC | 1610 | RSDHLAR | 1712 | QSSDLQR | 1814 | RSDSLTK | 1916 | 2 |
| 616 | GAGGAGGATG | 1611 | QSSNLQR | 1713 | RSDNLAR | 1815 | RSDNLQR | 1917 | 0.08 |
| 617 | AAGGGGGGG | 1612 | RSDHLSR | 1714 | RSDHLTR | 1816 | RKDNMTA | 1918 | 1 |
| 618 | AAGGGGGGG | 1613 | RSDHLSR | 1715 | RSDHLTR | 1817 | RKDNNTQ | 1919 | 0.55 |
| 619 | AAGGGGGGG | 1614 | RSDHLSR | 1716 | RSDHLTR | 1818 | RKDNMTN | 1920 | 1.34 |
| 620 | AAGGGGGGG | 1615 | RSDHLSR | 1717 | RSDHLTR | 1819 | RLDNRTA | 1921 | 0.54 |
| 621 | AAGGGGGGG | 1616 | RSDHLSR | 1718 | RSDHLTR | 1820 | RLDNRTQ | 1922 | 0.75 |
| 624 | ACGGATGTCT | 1617 | DRSALAR | 1719 | TSANLAR | 1821 | RSDTLRS | 1923 | 7 |
| 628 | TTGTAGGGA | 1618 | RSDHLTR | 1720 | RSDNLTT | 1822 | RGDALTS | 1924 | 130 |
| 629 | TTGTAGGGA | 1619 | RSSHLTR | 1721 | RSDNLTT | 1823 | RGDALTS | 1925 | 150 |
| 630 | CGGGGAGAGT | 1620 | RSDNLAR | 1722 | QSGHLQR | 1824 | RSDHLRE | 1926 | 37.5 |
| 646 | TTGGTGGAAG | 1621 | QSGNLAR | 1723 | RSDALAR | 1825 | RGDALTS | 1927 | 35 |

TABLE 4-continued

| SBS# | TARGET | SEQ ID F1 | SEQ ID F2 | SEQ ID F3 | SEQ ID | Kd (nM) |
|---|---|---|---|---|---|---|
| 647 | TTGGTGGAAG | 1622 QSANLAR | 1724 RSDALAR | 1826 RGDALTS | 1928 | 40 |
| 651 | GTTGTGGAAT | 1623 QSGNLSR | 1725 RSDALAR | 1827 NRATLAR | 1929 | 67.5 |
| 652 | TAGGAGGCTG | 1624 QSSDLQR | 1726 RSDNLAR | 1828 RSDNLTT | 1930 | 1.5 |
| 653 | TAGGAGGCTG | 1625 TTSDLTR | 1727 RSDNLAR | 1829 RSDNLTT | 1931 | 5.5 |
| 654 | TAGGCATAAA | 1626 QSGNLRT | 1728 QSGSLTR | 1830 RSDNLTT | 1932 | 105 |
| 655 | TAGGCATAAA | 1627 QSGNLRT | 1729 QSSTLRR | 1831 RSDNLTT | 1933 | 1000 |
| 656 | TAGGCATAAA | 1628 QSGNLRT | 1730 QSGSLTR | 1832 RSDNLTS | 1934 | 540 |
| 657 | TAGGCATAAA | 1629 QSGNLRT | 1731 QSSTLRR | 1833 RSDNLTS | 1935 | 300 |
| 660 | GAGGGAGTTC | 1630 NRATLAR | 1732 QSGHLTR | 1834 RSDNLAR | 1936 | 8.25 |
| 661 | GAGGGAGTTC | 1631 TTSALTR | 1733 QSGHLTR | 1835 RSDNLAR | 1937 | 1.73 |
| 665 | GCGGAGGCGC | 1632 RSDDVTR | 1734 RSDNLTR | 1836 RSDDLRR | 1938 | 12.5 |
| 689 | AAGGCGGAGA | 1633 RSDNLTR | 1735 RSDELQR | 1837 RLDNRTA | 1939 | 82.5 |
| 692 | AAGGCGGAGA | 1634 RSDNLTR | 1736 RSDELQR | 1838 RSDNLTQ | 1940 | 51 |
| 693 | AAGGCGGAGA | 1635 RSDNLTR | 1737 RADTLRR | 1839 RLDNRTA | 1941 | 95 |
| 694 | AAGGCGGAGA | 1636 RSDNLTR | 1738 EADTLRR | 1840 RSDNLTQ | 1942 | 28.5 |
| 695 | GGGGGCGAGC | 1637 RSSNLTR | 1739 DRSHLAR | 1841 RSDHLTR | 1943 | 850 |
| 697 | TGAGCGGCGG | 1638 RSDELTR | 1740 RSDELSR | 1842 QSGHLTK | 1944 | 200 |
| 698 | TGAGCGGCGG | 1639 RSDELTR | 1741 RSDELSR | 1843 QSHGLTS | 1945 | 300 |
| 699 | GCGGCGGCAG | 1640 QSGSLTR | 1742 RSDDLQR | 1844 RSDERKR | 1946 | 21.5 |
| 700 | GCGGCGGCAG | 1641 QSGDLTR | 1743 RSDDLQR | 1845 RSDERKR | 1947 | 45 |
| 701 | GCAGCGGAGC | 1642 RSDNLAR | 1744 RSDELQR | 1846 QSGSLTR | 1948 | 50.5 |
| 702 | GCAGCGGAGC | 1643 RSDNLAR | 1745 RSDELQR | 1847 QSGDLTR | 1949 | 73.5 |
| 704 | AAGGTGGCAG | 1644 QSGDLTR | 1746 RSDSLAR | 1848 RSDNLTQ | 1950 | 5 |
| 705 | GGGGTGGGGC | 1645 RSDHLAR | 1747 RSDSLAR | 1849 RSDHLSR | 1951 | 0.01 |
| 706 | GGGGTGGGGC | 1646 RSDHLAR | 1748 RSDSLLR | 1850 RSDHLSR | 1952 | 0.05 |
| 708 | GAGTCGGAA | 1647 QSANLAR | 1749 RQDTLVG | 1851 RSDNLAR | 1953 | 300 |
| 709 | GAGTCGGAA | 1648 QSANLAR | 1750 RKDVLVS | 1852 RSDNLAR | 1954 | 400 |
| 710 | GAGTCGGAA | 1649 QSGNLAR | 1751 RLDGLRT | 1853 RSDNLAR | 1955 | 400 |
| 711 | GAGTCGGAA | 1650 QSGNLAR | 1752 RQDTLVG | 1854 RSDNLAR | 1956 | 400 |
| 712 | GGTGAGGAGT | 1651 RSDNLAR | 1753 RSDNLAR | 1855 MSDHLSR | 1957 | 9.5 |
| 713 | GGTGAGGAGT | 1652 RSDNLAR | 1754 RSDNLAR | 1856 MSHHLSR | 1958 | 0.15 |
| 714 | TGGGTCGCGG | 1653 RSDELRR | 1755 DRSALAR | 1857 RSDHLTT | 1959 | 200 |
| 715 | TGGGTCGCGG | 1654 RADTLRR | 1756 DRSALAR | 1858 RSDHLTT | 1960 | 0.46 |
| 716 | TTGGGAGCAC | 1655 QSGSLTR | 1757 QSGHLQR | 1859 RGDALTS | 1961 | 200 |
| 717 | TTGGGAGCAC | 1656 QSGSLTR | 1758 QSGHLQR | 1860 RSDALTK | 1962 | 150 |
| 718 | TTGGGAGCAC | 1657 QSGSLTR | 1759 QSGHLQR | 1861 RSDALTR | 1963 | 107.5 |
| 719 | GGCATGGTGG | 1658 RSDALTR | 1760 RSDALTS | 1862 DRSHLAR | 1964 | 20 |
| 720 | GAAGAGGATG | 1659 TTSNLAR | 1761 RSDNLAR | 1863 QSGNLTR | 1965 | 1.6 |

TABLE 4-continued

| SBS# | TARGET | SEQ ID F1 | | SEQ ID F2 | | SEQ ID F3 | | SEQ ID | Kd (nM) |
|---|---|---|---|---|---|---|---|---|---|
| 722 | ATGGGGTGG | 1660 | RSDALTR | 1762 | RSDHLTR | 1864 | RSDALRQ | 1966 | 0.7 |
| 724 | GGCATGGTGG | 1661 | RSDALTR | 1763 | RSDALRQ | 1865 | DRSHLAR | 1967 | 2.5 |
| 725 | GCTTGAGTTA | 1662 | QSSALAR | 1764 | QSGHLQK | 1866 | QSSDLQR | 1968 | 3000 |
| 726 | GAAGAGGATG | 1663 | QSSNLAR | 1765 | RSDNLAR | 1867 | QSGNLTR | 1969 | 1.5 |
| 727 | GCGGTGGCTC | 1664 | QSSDLTR | 1766 | RSDALSR | 1868 | RSDTLKK | 1970 | 0.1 |
| 728 | GGTGAGGAGT | 1665 | RSDNLAR | 1767 | RSDNLAR | 1869 | DSSKLSR | 1971 | 15 |
| 729 | GGAGGGGAGT | 1666 | RSDNLAR | 1768 | RSDHLSR | 1870 | QSGHLAR | 1972 | 1000 |
| 730 | TGGGTCGCGG | 1667 | RSDDLTR | 1769 | DRSALAR | 1871 | RSDHLTT | 1973 | 1000 |
| 731 | GTGGGGGAGA | 1668 | RSDNLAR | 1770 | RSDHLSR | 1872 | RSDALAR | 1974 | 12 |
| 732 | GCGGGTGGGG | 1669 | RSDHLAR | 1771 | QSSHLAR | 1873 | RSDDLTR | 1975 | 22.5 |
| 733 | GCGGGTGGGG | 1670 | RSDHLAR | 1772 | QSSHLAR | 1874 | RSDTLKK | 1976 | 0.32 |
| 734 | GGGGCTGGGT | 1671 | RSDHLAR | 1773 | QSSDLSR | 1875 | RSDHLSR | 1977 | 0.25 |
| 735 | GCGGTGGCTC | 1672 | QSSDLTR | 1774 | RSDALSR | 1876 | RSDERKR | 1978 | 0.05 |
| 736 | GAGGTGGGGA | 1673 | RSDHLAR | 1775 | RSDALSR | 1877 | RSDNLSR | 1979 | 0.47 |
| 737 | GGAGGGGAGT | 1674 | RSDNLAR | 1776 | RSDHLSR | 1878 | QRGHLSR | 1980 | 1000 |
| 740 | AAGGTGGCAG | 1675 | QSGSLTR | 1777 | RSDALAR | 1879 | RSDNRTA | 1981 | 12.5 |
| 741 | AAGGCTGAGA | 1676 | RSDNLTR | 1778 | QSSDLQR | 1880 | RSDNLTQ | 1982 | 15 |
| 742 | ACGGGGTTAT | 1677 | QRGALAS | 1779 | RSDHLSR | 1881 | RSDTLKQ | 1983 | 29 |
| 743 | ACGGGGTTAT | 1678 | QRGALAS | 1780 | RSDHLSR | 1882 | RSDTLTQ | 1984 | 10 |
| 744 | ACGGGGTTAT | 1679 | QRSALAS | 1781 | RSDHLSR | 1883 | RSDTLKQ | 1985 | 8.33 |
| 745 | ACGGGGTTAT | 1680 | QRSALAS | 1782 | RSDHLSR | 1884 | RSDTLTQ | 1986 | 12.5 |
| 746 | CTGGAAGCAT | 1681 | QSGSLTR | 1783 | QSGNLAR | 1885 | RSDALRE | 1987 | 2.07 |
| 747 | CTATTTTGGG | 1682 | RSDHLTT | 1784 | QSSALRT | 1886 | QSGALRE | 1988 | 2000 |
| 748 | TTGGACGGCG | 1683 | DSGHLTR | 1785 | DRSNLER | 1887 | RGDALTS | 1989 | 112.3 |
| 749 | TTGGACGGCG | 1684 | DRSHLTR | 1786 | DSSNLTR | 1888 | RGDALTS | 1990 | 11.33 |
| 750 | GAGGGAGCGA | 1685 | RSDELTR | 1787 | QSAHLAR | 1889 | RSDNLAR | 1991 | 52 |
| 751 | GGTGAGGAGT | 1686 | RSDNLAR | 1788 | RSDNLAR | 1890 | NRSHLAR | 1992 | 7 |
| 752 | GAGGTGGGGA | 1687 | RSHHLAR | 1789 | RSDALSR | 1891 | RSDNLSR | 1993 | 31 |
| 757 | CGGGCGGCTG | 1688 | QSSDLRR | 1790 | RSDELQR | 1892 | RSDHLRE | 1994 | 14.5 |
| 758 | CGGGCGGCTG | 1689 | QSSDLRR | 1791 | RADTLRR | 1893 | RSDHLRE | 1995 | 16.5 |
| 759 | TTGGACGGCG | 1690 | DSGHLTR | 1792 | DSSNLTR | 1894 | RGDALTS | 1996 | 37 |
| 760 | TTGGACGGCG | 1691 | DRSHLTR | 1793 | DRSNLER | 1895 | RGDALTS | 1997 | 148.5 |
| 761 | GCGGTGGCTC | 1692 | QSSDLQR | 1794 | RSDALSR | 1896 | RSDERKR | 1998 | 6 |
| 762 | GCGGTGGCTC | 1693 | QSSDLQR | 1795 | RSDALSR | 1897 | RSDTLKK | 1999 | 18 |
| 776 | ATGGACGGGT | 1694 | RSDHLAR | 1796 | DRSNLER | 1898 | RSDSLNQ | 2000 | 0.4 |
| 777 | ATGGACGGGT | 1695 | RSDHLAR | 1797 | DRSNLTR | 1899 | RSDALSA | 2001 | 3.4 |
| 779 | CGGGGAGCAG | 1696 | QSGSLTR | 1798 | QSGHLTR | 1900 | RSDHLAE | 2002 | 0.5 |
| 780 | CGGGGAGCAG | 1697 | QSGSLTR | 1799 | QSGHLTR | 1901 | RSDHLRA | 2003 | 0.5 |

TABLE 4-continued

| SBS# | TARGET | SEQ ID F1 | | SEQ ID F2 | | SEQ ID F3 | | SEQ ID | Kd (nM) |
|---|---|---|---|---|---|---|---|---|---|
| 781 | GGGGAGCAGC | 1698 | RSSNLRE | 1800 | RSDNLAR | 1902 | RSDHLTR | 2004 | 4.25 |
| 783 | TTGGGAGCGG | 1699 | RSDELTR | 1801 | QSGHLQR | 1903 | RGDALTS | 2005 | 2000 |
| 785 | TTGGGAGCGG | 1700 | RSDTLKK | 1802 | QSGHLQR | 1904 | RSDALTS | 2006 | 50 |
| 786 | TTGGGAGCGG | 1701 | RSDTLKK | 1803 | QSGHLQR | 1905 | RGDALRS | 2007 | 2000 |
| 787 | AGGGAGGATG | 1702 | QSDNLAR | 1804 | RSDNLAR | 1906 | RSDHLTQ | 2008 | 4 |
| 826 | GAGGGAGCGA | 1703 | RSDELTR | 1805 | QSGHLAR | 1907 | RSDNLAR | 2009 | 2.75 |
| 827 | GAGGGAGCGA | 1704 | RADTLRR | 1806 | QSGHLAR | 1908 | RSDNLAR | 2010 | 1.2 |
| 882 | GCGTGGGCGT | 1705 | RSDELTR | 1807 | RSDHLTT | 1909 | RSDERKR | 2011 | 0.01 |
| 883 | CCGTGGGCGT | 1706 | RSDELTR | 1808 | RSDHLTT | 1910 | RSDERKR | 2012 | 1 |

TABLE 5

| SBS# | TARGET | SEQ ID F1 | | SEQ ID F2 | | SEQ ID F3 | | SEQ ID | Kd (Nm) |
|---|---|---|---|---|---|---|---|---|---|
| 903 | ATGGAAGGG | 2013 | RSDHLAR | 2513 | QSGNLAR | 3013 | RSDALRQ | 3513 | 1.027 |
| 904 | AAGGGTGAC | 2014 | DSSNLTR | 2514 | QSSHLAR | 3014 | RSDNLTQ | 3514 | 1 |
| 905 | GTGGTGGTG | 2015 | RSSALTR | 2515 | RSDSLAR | 3015 | RSDSLAR | 3515 | 1.15 |
| 908 | AAGGTCTCA | 2016 | QSGDLRT | 2516 | DRSALAR | 3016 | RSDNLRQ | 3516 | 50 |
| 909 | GTGGAAGAA | 2017 | QSGNLSR | 2517 | QSGNLQR | 3017 | RSDALAR | 3517 | 16.4 |
| 910 | ATGGAAGAT | 2018 | QSSNLAR | 2518 | QSGNLQR | 3018 | RSDALAQ | 3518 | 0.03 |
| 911 | ATGGGTGCA | 2019 | QSGSLTR | 2519 | QSSHLAR | 3019 | RSDALAQ | 3519 | 0.91 |
| 912 | TCAGAGGTG | 2020 | RSDSLAR | 2520 | RSDNLTR | 3020 | QSGDLRT | 3520 | 0.135 |
| 914 | CAGGAAAAG | 2021 | RSDNLTQ | 2521 | QSGNLAR | 3021 | RSDNLRE | 3521 | 1.26 |
| 915 | CAGGAAAAG | 2022 | RSDNLRQ | 2522 | QSGNLAR | 3022 | RSDNLRE | 3522 | 45.15 |
| 916 | GAGGAAGGA | 2023 | QSGHLAR | 2523 | QSGNLAR | 3023 | RSDNLQR | 3523 | 1.3 |
| 919 | TCATAGTAG | 2024 | RSDNLTT | 2524 | RSDNLRT | 3024 | QSGDLRT | 3524 | 250 |
| 920 | GATGTGGTA | 2025 | QSSSLVR | 2525 | RSDSLAR | 3025 | TSANLSR | 3525 | 4 |
| 921 | AAGGTCTCA | 2026 | QSGDLRT | 2526 | DPGALVR | 3026 | RSDNLRQ | 3526 | 11 |
| 922 | AAGGTCTCA | 2027 | QSHDLTK | 2527 | DRSALAR | 3027 | RSDNLRQ | 3527 | 4 |
| 923 | AAGGTCTCA | 2028 | QSHDLTK | 2528 | DPGALVR | 3028 | RSDNLRQ | 3528 | 2 |
| 926 | GTGGTGGTG | 2029 | RSDALTR | 2529 | RSDSLAR | 3029 | RSDSLAR | 3529 | 7.502 |
| 927 | CAGGTTGAG | 2030 | RSDNLAR | 2530 | TSGSLTR | 3030 | RSDNLRE | 3530 | 3.61 |
| 928 | CAGGTTGAG | 2031 | RSDNLAR | 2531 | QSSALTR | 3031 | RSDNLRE | 3531 | 25 |
| 929 | CAGGTAGAT | 2032 | QSSNLAR | 2532 | QSATLAR | 3032 | RSDNLRE | 3532 | 1.3 |
| 931 | GAGGAAGAG | 2033 | RSDNLAR | 2533 | QSSNLVR | 3033 | RSDNLAR | 3533 | 2 |
| 932 | ATGGAAGGG | 2034 | RSDHLAR | 2534 | QSSNLVR | 3034 | RSDALRQ | 3534 | 797 |
| 933 | GACGAGGAA | 2035 | QSANLAR | 2535 | RSDNLAR | 3035 | DRSNLTR | 3535 | 500 |
| 934 | ATGGAAGAT | 2036 | QSSNLAR | 2536 | QSGNLQR | 3036 | RSDALTS | 3536 | 0.07 |
| 935 | ATGGGTGCA | 2037 | QSGSLTR | 2537 | QSSHLAR | 3037 | RSDALTS | 3537 | 0.91 |

TABLE 5-continued

| SBS# | TARGET | SEQ ID | F1 | SEQ ID | F2 | SEQ ID | F3 | SEQ ID | Kd (Nm) |
|---|---|---|---|---|---|---|---|---|---|
| 937 | GTGGGGGCT | 2038 | QSSDLTR | 2538 | RSDHLTR | 3038 | RSDSLAR | 3538 | 0.03 |
| 938 | GTGGGGGCT | 2039 | QSSDLRR | 2539 | RSDHLTR | 3039 | RSDSLAR | 3539 | 0.049 |
| 939 | GGGGGCTGG | 2040 | RSDHLTT | 2540 | DRSHLAR | 3040 | RSDHLSK | 3540 | 0.352 |
| 940 | GGGGGCTGG | 2041 | RSDHLTK | 2541 | DRSHLAR | 3041 | RSDHLSK | 3541 | 1.5 |
| 941 | GGGGCTGGG | 2042 | RSDHLAR | 2542 | QSSDLRR | 3042 | RSDKLSR | 3542 | 0.077 |
| 942 | GGGGCTGGG | 2043 | RSDHLAR | 2543 | QSSDLRR | 3043 | RSDHLSK | 3543 | 0.13 |
| 943 | GGGGCTGGG | 2044 | RSDHLAR | 2544 | TSGELVR | 3044 | RSDKLSR | 3544 | 0.067 |
| 944 | GGGGCTGGG | 2045 | RSDHLAR | 2545 | TSGELVR | 3045 | RSDHLSK | 3545 | 0.027 |
| 945 | GGTGCGGTG | 2046 | RSDSLTR | 2546 | RADTLRR | 3046 | MSHHLSR | 3546 | 0.027 |
| 946 | GGTGCGGTG | 2047 | RSDSLTR | 2547 | RSDVLQR | 3047 | MSHHLSR | 3547 | 0.027 |
| 947 | GGTGCGGTG | 2048 | RSDSLTR | 2548 | RSDELQR | 3048 | QSSHLAR | 3548 | 0.013 |
| 948 | GGTGCGGTG | 2049 | RSDSLTR | 2549 | RSDVLQR | 3049 | QSSHLAR | 3549 | 0.017 |
| 962 | GAGGCGGCA | 2050 | QSGSLTR | 2550 | RSDELQR | 3050 | RSDNLAR | 3550 | 0.015 |
| 963 | GAGGCGGCA | 2051 | QSGSLTR | 2551 | RSDDLQR | 3051 | RSDNLAR | 3551 | 0.015 |
| 964 | GCGGCGGTG | 2052 | RSDALAR | 2552 | RSDELQR | 3052 | RSDERKR | 3552 | 0.041 |
| 965 | GCGGCGGCC | 2053 | ERGDLTR | 2553 | RSDELQR | 3053 | RSDERKR | 3553 | 3.1 |
| 966 | GAGGAGGCC | 2054 | ERGTLAR | 2554 | RSDNLSR | 3054 | RSDNLAR | 3554 | 0.028 |
| 967 | GAGGAGGCC | 2055 | DRSSLTR | 2555 | RSDNLSR | 3055 | RSDNLAR | 3555 | 0.055 |
| 968 | GAGGCCGCA | 2056 | QSGSLTR | 2556 | DRSSLTR | 3056 | RSDNLAR | 3556 | 1.4 |
| 969 | GAGGCCGCA | 2057 | QSGSLTR | 2557 | DRSDLTR | 3057 | RSDNLAR | 3557 | 0.275 |
| 970 | GTGGGCGCC | 2058 | ERGTLAR | 2558 | DRSHLAR | 3058 | RSDALAR | 3558 | 1.859 |
| 971 | GTGGGCGCC | 2059 | DRSSLTR | 2559 | DRSHLAR | 3059 | RSDALAR | 3559 | 0.144 |
| 972 | GTGGGCGCC | 2060 | ERGDLTR | 2560 | DRSHLAR | 3060 | RSDALAR | 3560 | 1.748 |
| 973 | GCCGCGGTC | 2061 | DRSALTR | 2561 | RSDELQR | 3061 | ERGTLAR | 3561 | 0.6 |
| 974 | GCCGCGGTC | 2062 | DRSALTR | 2562 | RSDELQR | 3062 | DRSDLTR | 3562 | 0.038 |
| 975 | CAGGCCGCT | 2063 | QSSDLTR | 2563 | DRSSLTR | 3063 | RSDNLRE | 3563 | 1.1 |
| 976 | CAGGCCGCT | 2064 | QSSDLTR | 2564 | DRSDLTR | 3064 | RSDNLRE | 3564 | 4.12 |
| 977 | CTGGCAGTG | 2065 | RSDSLTR | 2565 | QSGSLTR | 3065 | RSDALRE | 3565 | 0.017 |
| 978 | CTGGCAGTG | 2066 | RSDSLTR | 2566 | QSGDLTR | 3066 | RSDALRE | 3566 | 1.576 |
| 979 | CTGGCGGCG | 2067 | RSSDLTR | 2567 | RSDELQR | 3067 | RSDALRE | 3567 | 1.59 |
| 980 | CTGGCGGCG | 2068 | RSDDLTR | 2568 | RSDELQR | 3068 | RSDALRE | 3568 | 2.2 |
| 981 | CAGGCGGCG | 2069 | RSDDLTR | 2569 | RSDELQR | 3069 | RSDNLRE | 3569 | 0.375 |
| 982 | CCGGGCTGG | 2070 | RSDHLTT | 2570 | DRSHLAR | 3070 | RSDELRE | 3570 | 0.03 |
| 983 | CCGGGCTGG | 2071 | RSDHLTK | 2571 | DRSHLAR | 3071 | RSDELRE | 3571 | 1.385 |
| 984 | GACGGCGAG | 2072 | RSDNLAR | 2572 | DRSHLAR | 3072 | DRSNLTR | 3572 | 1.6 |
| 985 | GACGGCGAG | 2073 | RSDNLAR | 2573 | DRSHLAR | 3073 | EKANLTR | 3573 | 0.965 |
| 986 | GGTGCTGAT | 2074 | QSSNLQR | 2574 | QSSDLQR | 3074 | MSHHLSR | 3574 | 1.6 |
| 987 | GGTGCTGAT | 2075 | QSSNLQR | 2575 | QSSDLQR | 3075 | TSGHLVR | 3575 | 33.55 |

TABLE 5-continued

| SBS# | TARGET | SEQ ID | F1 | SEQ ID | F2 | SEQ ID | F3 | SEQ ID | Kd (Nm) |
|---|---|---|---|---|---|---|---|---|---|
| 988 | GGTGCTGAT | 2076 | TSGNLVR | 2576 | QSSDLQR | 3076 | MSHHLSR | 3576 | 0.15 |
| 989 | GGTGAGGGG | 2077 | RSDHLAR | 2577 | RSDNLAR | 3077 | MSHHLSR | 3577 | 1.9 |
| 990 | AAGGTGGGC | 2078 | DRSHLTR | 2578 | RSDSLAR | 3078 | RSDNLTQ | 3578 | 5.35 |
| 991 | AAGGTGGGC | 2079 | DRSHLTR | 2579 | SSGSLVR | 3079 | RSDNLTQ | 3579 | 0.06 |
| 993 | GGGGCTGGG | 2080 | RSDHLAR | 2580 | TSGELVR | 3080 | RSDHLSR | 3580 | 3.1 |
| 994 | GGGGGCTGG | 2081 | RSDHLTK | 2581 | DRSHLAR | 3081 | RSDHLSR | 3581 | 0.03 |
| 995 | GGGGAGGAA | 2082 | QSANLAR | 2582 | RSDNLAR | 3082 | RSDHLSK | 3582 | 0.08 |
| 996 | CAGTTGGTC | 2083 | DRSALAR | 2583 | RSDALTS | 3083 | RSDNLRE | 3583 | 9.6 |
| 997 | AGAGAGGCT | 2084 | QSSDLTR | 2584 | RSDNLAR | 3084 | QSGHLNQ | 3584 | 1.65 |
| 998 | ACGTAGTAG | 2085 | RSANLRT | 2585 | RSDNLTK | 3085 | RSDTLKQ | 3585 | 0.23 |
| 999 | AGAGAGGCT | 2086 | QSSDLTR | 2586 | RSDNLAR | 3086 | QSGKLTQ | 3586 | 0.6 |
| 1000 | CAGTTGGTC | 2087 | DRSALAR | 2587 | RSDALTS | 3087 | RSDNLRE | 3587 | 11.15 |
| 1001 | GGAGCTGAC | 2088 | EKANLTR | 2588 | QSSDLSR | 3088 | QPAHLAR | 3588 | 1.8 |
| 1002 | GCGGAGGAG | 2089 | RSDNLVR | 2589 | RSDNLAR | 3089 | RSDERKR | 3589 | 0.028 |
| 1003 | ACGTAGTAG | 2090 | RSANLRT | 2590 | RSDNLTK | 3090 | RSDTLRS | 3590 | 0.118 |
| 1004 | ACGTAGTAG | 2091 | RSDNLTT | 2591 | RSDNLTK | 3091 | RSDTLRS | 3591 | 1.4 |
| 1006 | GTAGGGGCG | 2092 | RSDDLTR | 2592 | RSDHLTR | 3092 | QRASLTR | 3592 | 0.898 |
| 1007 | GAGAGAGAT | 2093 | QSSNLQR | 2593 | QSGHLTR | 3093 | RLHNLAR | 3593 | 167 |
| 1008 | GAGATGGAG | 2094 | RSDNLSR | 2594 | RSDSLTQ | 3094 | RLHNLAR | 3594 | 0.4 |
| 1009 | GAGATGGAG | 2095 | RSDNLSR | 2595 | RSDSLTQ | 3095 | RSDNLSR | 3595 | 1.9 |
| 1010 | GAGAGAGAT | 2096 | QSSNLQR | 2596 | QSGHLTR | 3096 | RSDNLAR | 3596 | 8.2 |
| 1011 | TTGGTGGCG | 2097 | RSADLTR | 2597 | RSDSLAR | 3097 | RSDSLTK | 3597 | 0.03 |
| 1012 | GACGTAGGG | 2098 | RSDHLTR | 2598 | QSSSLVR | 3098 | DRSNLTR | 3598 | 0.032 |
| 1013 | GAGAGAGAT | 2099 | QSSNLQR | 2599 | QSGHLNQ | 3099 | RSDNLAR | 3599 | 0.15 |
| 1014 | GACGTAGGG | 2100 | RSDHLTR | 2600 | QSGSLTR | 3100 | DRSNLTR | 3600 | 0.01 |
| 1015 | GCGGAGGAG | 2101 | RSDNLVR | 2601 | RSDNLAR | 3101 | RSDTLKK | 3601 | 0.008 |
| 1016 | CAGTTGGTC | 2102 | DRSALAR | 2602 | RSDSLTK | 3102 | RSDNLRE | 3602 | 0.09 |
| 1017 | CTGGATGAC | 2103 | EKANLTR | 2603 | TSGNLVR | 3103 | RSDALRE | 3603 | 0.233 |
| 1018 | GTAGTAGAA | 2104 | QSANLAR | 2604 | QSSSLVR | 3104 | QPASLAR | 3604 | 7.2 |
| 1019 | AGGGAGGAG | 2105 | RSDNLAR | 2605 | RSDNLAR | 3105 | RSDHLTQ | 3605 | 0.022 |
| 1020 | ACGTAGTAG | 2106 | RSDNLTT | 2606 | RSDNLTK | 3106 | RSDTLKQ | 3606 | 0.69 |
| 1022 | GAGGAGGTG | 2107 | RSDALAR | 2607 | RSDNLAR | 3107 | RSDNLAR | 3607 | 0.01 |
| 1024 | GGGGAGGAA | 2108 | QSANLAR | 2608 | RSDNLAR | 3108 | RSDHLSR | 3608 | 0.08 |
| 1025 | GAGGAGGTG | 2109 | QSSALTR | 2609 | QSSSLVR | 3109 | RSDTLTQ | 3609 | 0.115 |
| 1026 | GTGGCTTGT | 2110 | MSHHLKE | 2610 | QSSDLSR | 3110 | RSDALAR | 3610 | 0.076 |
| 1027 | GCGGCGGTG | 2111 | RSDALAR | 2611 | RSDELQR | 3111 | RSDELQR | 3611 | 0.054 |
| 1032 | GGTGCTGAT | 2112 | TSGNLVR | 2612 | QSSDLQR | 3112 | TSGHLVR | 3612 | 0.52 |
| 1033 | GTGTTCGTG | 2113 | RSDALAR | 2613 | DRSALTT | 3113 | RSDALAR | 3613 | 685.2 |

TABLE 5-continued

| SBS# | TARGET | SEQ ID | F1 | SEQ ID | F2 | SEQ ID | F3 | SEQ ID | Kd (Nm) |
|---|---|---|---|---|---|---|---|---|---|
| 1034 | GTGTTCGTG | 2114 | RSDALAR | 2614 | DRSALTK | 3114 | RSDALAR | 3614 | 14.55 |
| 1035 | GTGTTCGTG | 2115 | RSDALAR | 2615 | DRSALRT | 3115 | RSDALAR | 3615 | 56 |
| 1037 | GTAGGGGCA | 2116 | QSGSLTR | 2616 | RSDHLSR | 3116 | QRASLAR | 3616 | 0.05 |
| 1038 | GTAGGGGCA | 2117 | QTGELRR | 2617 | RSDHLSR | 3117 | QPASLAR | 3617 | 0.152 |
| 1039 | GGGGCTGGG | 2118 | RSDHLSR | 2618 | TSGELVR | 3118 | RSDHLTR | 3618 | 1.37 |
| 1040 | GGGGCTGGG | 2119 | RSDHLSR | 2619 | QSSDLQR | 3119 | RSDHLSK | 3619 | 0.05 |
| 1041 | TCATAGTAG | 2120 | RSDNLTT | 2620 | RSDNLRT | 3120 | QSHDLTK | 3620 | 2.06 |
| 1043 | CAGGGAGAG | 2121 | RSDNLAR | 2621 | QSGHLTR | 3121 | RSDNLRE | 3621 | 0.16 |
| 1044 | CAGGGAGAG | 2122 | RSDNLAR | 2622 | QRAHLER | 3122 | RSDNLRE | 3622 | 1.07 |
| 1045 | GGGGCAGGA | 2123 | QSGHLAR | 2623 | QSGSLTR | 3123 | RSDHLSR | 3623 | 0.15 |
| 1046 | GGGGCAGGA | 2124 | QSGHLAR | 2624 | QSGDLRR | 3124 | RSDHLSR | 3624 | 0.09 |
| 1047 | GGGGCAGGA | 2125 | QRAHLER | 2625 | QSGSLTR | 3125 | RSDHLSR | 3625 | 24.7 |
| 1048 | CAGGCTGTA | 2126 | QSGALTR | 2626 | QSSDLQR | 3126 | RSDNLRE | 3626 | 1.387 |
| 1049 | CAGGCTGTA | 2127 | QRASLAR | 2627 | QSSDLQR | 3127 | RSDNLRE | 3627 | 55.6 |
| 1050 | CAGGCTGTA | 2128 | QSSSLVR | 2628 | QSSDLQR | 3128 | RSDNLRE | 3628 | 0.125 |
| 1051 | GAGGCTGAG | 2129 | RSDNLTR | 2629 | QSSDLQR | 3129 | RSDNLVR | 3629 | 0.02 |
| 1052 | TAGGACGGG | 2130 | RSDHLAR | 2630 | EKANLTR | 3130 | RSDNLTT | 3630 | 0.28 |
| 1053 | TAGGACGGG | 2131 | RSDHLAR | 2631 | DRSNLTR | 3131 | RSDNLTT | 3631 | 0.025 |
| 1054 | GCTGCAGGG | 2132 | RSDHLAR | 2632 | QSGSLTR | 3132 | QSSDLQR | 3632 | 0.033 |
| 1055 | GCTGCAGGG | 2133 | RSDHLAR | 2633 | QSGSLTR | 3133 | TSGDLTR | 3633 | 18.73 |
| 1056 | GCTGCAGGG | 2134 | RSDHLAR | 2634 | QSGSLTR | 3134 | QSSDLQR | 3634 | 0.045 |
| 1057 | GCTGCAGGG | 2135 | RSDHLAR | 2635 | QSGDLTR | 3135 | TSGDLTR | 3635 | 0.483 |
| 1058 | GGGGCCGCG | 2136 | RSDELTR | 2636 | DRSSLTR | 3136 | RSDHLSR | 3636 | 6.277 |
| 1059 | GGGGCCGCG | 2137 | RSDELTR | 2637 | DRSDLTR | 3137 | RSDHLSR | 3637 | 0.152 |
| 1060 | GCGGAGGCC | 2138 | ERGTLAR | 2638 | RSDNLAR | 3138 | RSDERKR | 3638 | 0.69 |
| 1061 | GTTGCGGGG | 2139 | RSDHLAR | 2639 | RSDELQR | 3139 | QSSALTR | 3639 | 0.165 |
| 1062 | GTTGCGGGG | 2140 | RSDHLAR | 2640 | RSDELQR | 3140 | TSGSLTR | 3640 | 0.068 |
| 1063 | GTTGCGGGG | 2141 | RSDHLAR | 2641 | RSDELQR | 3141 | MSHALSR | 3641 | 0.96 |
| 1064 | GCGGCAGTG | 2142 | RSDALTR | 2642 | QSGSLTR | 3142 | RSDERKR | 3642 | 0.453 |
| 1065 | TGGGGCGGG | 2143 | RSDHLAR | 2643 | DRSHLAR | 3143 | RSDHLTT | 3643 | 1.37 |
| 1066 | GAGGGCGGT | 2144 | QSSHLTR | 2644 | DRSHLAR | 3144 | RSDNLVR | 3644 | 0.15 |
| 1067 | GAGGGCGGT | 2145 | TSGHLVR | 2645 | DRSHLAR | 3145 | RSDNLVR | 3645 | 1.37 |
| 1068 | GCAGGGGGC | 2146 | DRSHLTR | 2646 | RSDHLTR | 3146 | QSGDLTR | 3646 | 2.05 |
| 1069 | GCAGGCGGT | 2147 | DRSHLTR | 2647 | RSDHLTR | 3147 | QSGSLTR | 3647 | 0.1 |
| 1070 | GGGGCAGGC | 2148 | DRSHLTR | 2648 | QSGSLTR | 3148 | RSDHLSR | 3648 | 0.456 |
| 1071 | GGGGCAGGC | 2149 | DRSHLTR | 2649 | QSGDLTR | 3149 | RSDHLSR | 3649 | 0.2 |
| 1072 | GGATTGGCT | 2150 | QSSDLTR | 2650 | RSDALTT | 3150 | QRAHLAR | 3650 | 0.46 |
| 1073 | GGATTGGCT | 2151 | QSSDLTR | 2651 | RSDALTK | 3151 | QRAHLAR | 3651 | 1.37 |

TABLE 5-continued

| SBS# | TARGET | SEQ ID | F1 | SEQ ID | F2 | SEQ ID | F3 | SEQ ID | Kd (Nm) |
|---|---|---|---|---|---|---|---|---|---|
| 1075 | GTGTTGGCG | 2152 | RSDELTR | 2652 | RSDALTK | 3152 | RSDALTR | 3652 | 0.915 |
| 1076 | GCGGCAGCG | 2153 | RSDELTR | 2653 | QSGSLTR | 3153 | RSDERKR | 3653 | 4.1 |
| 1077 | GCGGCAGCG | 2154 | RSDELTR | 2654 | QSGDLRR | 3154 | RSDERKR | 3654 | 6.2 |
| 1078 | GGGGGGGCC | 2155 | ERGTLAR | 2655 | RSDHLSR | 3155 | RSDHLSR | 3655 | 0.2 |
| 1079 | GGGGGGGCC | 2156 | ERGDLTR | 2656 | RSDHLSR | 3156 | RSDHLSR | 3656 | 4.1 |
| 1080 | CTGGAGGCG | 2157 | RSDELTR | 2657 | RSDNLAR | 3157 | RSDALRE | 3657 | 1.37 |
| 1081 | GGGGAGGTG | 2158 | RSDALTR | 2658 | RSDNLTR | 3158 | RSDHLSR | 3658 | 0.05 |
| 1082 | CTGGCGGCG | 2159 | RSDELTR | 2659 | RSDELTR | 3159 | RSDALRE | 3659 | 0.152 |
| 1083 | CTGGTGGCA | 2160 | QSGDLTR | 2660 | RSDALSR | 3160 | RSDALRE | 3660 | 0.152 |
| 1084 | GGTGAGGCG | 2161 | RSDELTR | 2661 | RSDNLAR | 3161 | MSHHLSR | 3661 | 0.5 |
| 1085 | GGTGAGGCG | 2162 | RSDELTR | 2662 | RSDNLAR | 3162 | QSSHLAR | 3662 | 0.46 |
| 1086 | GGGGCTGGG | 2163 | RSDHLSR | 2663 | QSSDLQR | 3163 | RSDHLTR | 3663 | 0.1 |
| 1087 | CGGGCGGCC | 2164 | ERGDLTR | 2664 | RSDELQR | 3164 | RSDHLAE | 3664 | 1.24 |
| 1088 | CGGGCGGCC | 2165 | ERGDLTR | 2665 | RSDELQR | 3165 | RSDHLRE | 3665 | 0.905 |
| 1089 | GACGAGGCT | 2166 | QSSDLRR | 2666 | RSDNLAR | 3166 | DRSNLTR | 3666 | 0.171 |
| 1090 | AAGGCGCTG | 2167 | RSDALRE | 2667 | RSDELQR | 3167 | RSDNLTQ | 3667 | 30.3 |
| 1091 | GTAGAGGAC | 2168 | DRSNLTR | 2668 | RSDNLAR | 3168 | QPASLAR | 3668 | 0.085 |
| 1092 | GCCTTGGCT | 2169 | QSSDLRR | 2669 | RGDALTS | 3169 | DRSDLTR | 3669 | 2.735 |
| 1093 | GCGGAGTCG | 2170 | RSADLRT | 2670 | RSDNLAR | 3170 | RSDERKR | 3670 | 0.046 |
| 1094 | GCGGTTGGT | 2171 | TSGHLVR | 2671 | QSSALTR | 3171 | RSDERKR | 3671 | 12.34 |
| 1095 | GGGGGAGCC | 2172 | ERGDLTR | 2672 | QRAHLER | 3172 | RSDHLSR | 3672 | 0.395 |
| 1096 | GGGGGAGCC | 2173 | DRSSLTR | 2673 | QRAHLER | 3173 | RSDHLSR | 3673 | 0.019 |
| 1097 | GAGGCCGAA | 2174 | QSANLAR | 2674 | DCRDLAR | 3174 | RSDNLAR | 3674 | 0.77 |
| 1098 | GCCGGGGAG | 2175 | RSDNLTR | 2675 | RSDHLTR | 3175 | DRSDLTR | 3675 | 0.055 |
| 1099 | GCGGAGTCG | 2176 | TSGHLVR | 2676 | TSGSLTR | 3176 | RSDERKR | 3676 | 0.45 |
| 1100 | GTGTTGGTA | 2177 | QSGALTR | 2677 | RGDALTS | 3177 | RSDALTR | 3677 | 1.4 |
| 1101 | ATGGGAGTT | 2178 | TTSALTR | 2678 | QRAHLER | 3178 | RSDALRQ | 3678 | 0.065 |
| 1102 | AAGGCAGAA | 2179 | QSANLAR | 2679 | QSGSLTR | 3179 | RSDNLTQ | 3679 | 8.15 |
| 1103 | AAGGCAGAA | 2180 | QSANLAR | 2680 | QSGDLTR | 3180 | RSDNLTQ | 3680 | 1.4 |
| 1104 | CGGGCAGCT | 2181 | QSSDLRR | 2681 | QSGSLTR | 3181 | RSDHLRE | 3681 | 0.08 |
| 1105 | CTGGCAGCC | 2182 | ERGDLTR | 2682 | QSGDLTR | 3182 | RSDALRE | 3682 | 2.45 |
| 1106 | CTGGCAGCC | 2183 | DRSSLTR | 2683 | QSGDLTR | 3183 | RSDALRE | 3683 | 0.19 |
| 1107 | GCGGAGTT | 2184 | QSSALAR | 2684 | QRAHLER | 3184 | RSDERKR | 3684 | 0.06 |
| 1108 | CAGGCTGGA | 2185 | QSGHLAR | 2685 | TSGELVR | 3185 | RSDNLRE | 3685 | 0.007 |
| 1109 | AGGGGAGCC | 2186 | ERGDLTR | 2686 | QRAHLER | 3186 | RSDHLTQ | 3686 | 0.347 |
| 1110 | AGGGGAGCC | 2187 | DRSSLTR | 2687 | QRAHLER | 3187 | RSDHLTQ | 3687 | 0.095 |
| 1111 | CTGGTAGGG | 2188 | RSDHLAR | 2688 | QSSSLVR | 3188 | RSDALRE | 3688 | 0.095 |
| 1112 | CTGGTAGGG | 2189 | RSDHLAR | 2689 | QSATLAR | 3189 | RSDALRE | 3689 | 0.125 |

TABLE 5-continued

| SBS# | TARGET | SEQ ID | F1 | SEQ ID | F2 | SEQ ID | F3 | SEQ ID | Kd (Nm) |
|---|---|---|---|---|---|---|---|---|---|
| 1113 | CTGGGGGCA | 2190 | QSGDLTR | 2690 | RSDHLTR | 3190 | RSDALRE | 3690 | 0.06 |
| 1114 | CAGGTTGAT | 2191 | QSSNLAR | 2691 | TSGSLTR | 3191 | RSDNLRE | 3691 | 2.75 |
| 1115 | CAGGTTGAT | 2192 | QSSNLAR | 2692 | QSSALTR | 3192 | RSDNLRE | 3692 | 0.7 |
| 1116 | CCGGAAGCG | 2193 | RSDELTR | 2693 | QSSNLVR | 3193 | RSDELRE | 3693 | 12.3 |
| 1117 | GCAGCGCAG | 2194 | RSSNLRE | 2694 | RSDELTR | 3194 | QSGSLTR | 3694 | 2.85 |
| 1118 | TAGGGAGTC | 2195 | DRSALTR | 2695 | QRAHLER | 3195 | RSDNLTT | 3695 | 1.4 |
| 1119 | TGGGAGGGT | 2196 | TSGHLVR | 2696 | RSDNLAR | 3196 | RSDHLTT | 3696 | 0.1 |
| 1120 | AGGGACGCG | 2197 | RSDELTR | 2697 | DRSNLTR | 3197 | RSDHLTQ | 3697 | 2.735 |
| 1121 | CTGGTGGCC | 2198 | ERGDLTR | 2698 | RSDALTR | 3198 | RSDALRE | 3698 | 2.76 |
| 1122 | CTGGTGGCC | 2199 | DRSSLTR | 2699 | RSDALTR | 3199 | RSDALRE | 3699 | 0.101 |
| 1123 | TAGGAAGCA | 2200 | QSGSLTR | 2700 | QSGNLAR | 3200 | RSDNLTT | 3700 | 0.065 |
| 1124 | GTGGATGGA | 2201 | QSGHLAR | 2701 | TSGNLVR | 3201 | RSDALTR | 3701 | 0.101 |
| 1126 | TTGGCTATG | 2202 | RSDALTS | 2702 | TSGELVR | 3202 | RGDALTS | 3702 | 0.46 |
| 1127 | CAGGGGGTT | 2203 | QSSALAR | 2703 | RSDHLTR | 3203 | RSDNLRE | 3703 | 0.1 |
| 1128 | AAGGTCGCC | 2204 | ERGDLTR | 2704 | DPGALVR | 3204 | RSDNLTQ | 3704 | 5.45 |
| 1130 | GGTGCAGAC | 2205 | DRSNLTR | 2705 | QSGDLTR | 3205 | MSHHLSR | 3705 | 0.1 |
| 1131 | GTGGGAGCC | 2206 | ERGDLTR | 2706 | QRAHLER | 3206 | RSDALTR | 3706 | 0.95 |
| 1132 | GGGGCTGGA | 2207 | QSCHLAR | 2707 | TSGELVR | 3207 | RSDHLSR | 3707 | 0.055 |
| 1133 | GGGGCTGGA | 2208 | QRAHLER | 2708 | TSGELVR | 3208 | RSDHLSR | 3708 | 0.5 |
| 1134 | TGGGGGTGG | 2209 | RSDHLTT | 2709 | RSDHLTR | 3209 | RSDHLTT | 3709 | 0.067 |
| 1135 | GCGGCGGGG | 2210 | RSDHLAR | 2710 | RSDELQR | 3210 | RSDERKR | 3710 | 0.025 |
| 1136 | CCGGGAGTG | 2211 | RSDALTR | 2711 | QRAHLER | 3211 | RSDTLRE | 3711 | 0.225 |
| 1137 | CCGGGAGTG | 2212 | RSSALTR | 2712 | QRAHLER | 3212 | RSDTLRE | 3712 | 0.085 |
| 1138 | CAGGGGGTA | 2213 | QSGALTR | 2713 | RSDHLTR | 3213 | RSDNLRE | 3713 | 0.027 |
| 1139 | ACGGCCGAG | 2214 | RSDNLAR | 2714 | DRSDLTR | 3214 | RSDTLTQ | 3714 | 0.535 |
| 1140 | AAGGGTGCG | 2215 | RSDELTR | 2715 | QSSHLAR | 3215 | RSDNLTQ | 3715 | 0.3 |
| 1141 | ATGGACTTG | 2216 | RGDALTS | 2716 | DRSNLTR | 3216 | RSDALTQ | 3716 | 1.7 |
| 1148 | TTGGAGGAG | 2217 | RSDNLTR | 2717 | RSDNLTR | 3217 | RGDALTS | 3717 | 0.006 |
| 1149 | TTGGAGGAG | 2218 | RSDNLTR | 2718 | RSDNLTR | 3218 | RSDALTK | 3718 | 0.004 |
| 1150 | GAAGAGGCA | 2219 | QSGSLTR | 2719 | RSDNLTR | 3219 | QSGNLTR | 3719 | 0.004 |
| 1151 | GTAGTATGG | 2220 | RSDHLTT | 2720 | QRSALAR | 3220 | QRASLAR | 3720 | 1.63 |
| 1152 | AAGGCTGGA | 2221 | QSGHLAR | 2721 | TSGELVR | 3221 | RSDNLTQ | 3721 | 1.605 |
| 1153 | AAGGCTGGA | 2222 | QRAHLAR | 2722 | TSGELVR | 3222 | RSDNLTQ | 3722 | 8.2 |
| 1154 | CTGGCGTAG | 2223 | RSDNLTT | 2723 | RSDELQR | 3223 | RSDALRE | 3723 | 1.04 |
| 1156 | ATGGTTGAA | 2224 | QSANLAR | 2724 | QSSALTR | 3224 | RSDALRQ | 3724 | 7.2 |
| 1157 | ATGGTTGAA | 2225 | QSANLAR | 2725 | TSGSLTR | 3225 | RSDALRQ | 3725 | 0.885 |
| 1158 | AGGGGAGAA | 2226 | QSANLAR | 2726 | QSGHLTR | 3226 | RSDHLTQ | 3726 | 0.1 |
| 1159 | AGGGGAGAA | 2227 | QSANLAR | 2727 | QRAHLER | 3227 | RSDHLTQ | 3727 | 0.555 |

TABLE 5-continued

| SBS# | TARGET | SEQ ID | F1 | SEQ ID | F2 | SEQ ID | F3 | SEQ ID | Kd (Nm) |
|------|--------|--------|------|--------|--------|--------|--------|------|-------|
| 1160 | TGGGAAGGC | 2228 | DRSHLAR | 2728 | QSSNLVR | 3228 | RSDHLTT | 3728 | 0.415 |
| 1161 | GAGGCCGCC | 2229 | DRSHLAR | 2729 | DRSDLTR | 3229 | RSDNLAR | 3729 | 0.45 |
| 1162 | GTGTTGGTA | 2230 | QSGALTR | 2730 | RADALMV | 3230 | RSDALTR | 3730 | 0.465 |
| 1163 | GTGTGAGCC | 2231 | ERGDLTR | 2731 | QSGHLTT | 3231 | RSDALTR | 3731 | 1.45 |
| 1164 | GTGTGAGCC | 2232 | ERGDLTR | 2732 | QSVHLQS | 3232 | RSDALTR | 3732 | 15.4 |
| 1165 | GCGAAGGTG | 2233 | RSDALTR | 2733 | RSDNLTQ | 3233 | RSDERKR | 3733 | 1.4 |
| 1166 | GCGAAGGTG | 2234 | RSDALTR | 2734 | RSDNLTQ | 3234 | RSSDRKR | 3734 | 0.195 |
| 1167 | GCGAAGGTG | 2235 | RSDALTR | 2735 | RSDNLTQ | 3235 | RSHDRKR | 3735 | 0.95 |
| 1168 | AAGGCGCTG | 2236 | RSDALRE | 2736 | RSSDLTR | 3236 | RSDNLTQ | 3736 | 2.8 |
| 1169 | GTAGAGGAC | 2237 | DRSNLTR | 2737 | RSDNLAR | 3237 | QSSSLVR | 3737 | 0.053 |
| 1170 | GCCTTGGCT | 2238 | QSSDLRR | 2738 | RADALMV | 3238 | DRSDLTR | 3738 | 2.75 |
| 1171 | GCGGAGTCG | 2239 | RSDDLRT | 2739 | RSDNLAR | 3239 | RSDERKR | 3739 | 0.18 |
| 1172 | GCCGGGGAG | 2240 | RSDNLTR | 2740 | RSDHLTR | 3240 | ERGDLTR | 3740 | 0.01 |
| 1173 | GCTGAAGGG | 2241 | RSDHLSR | 2741 | QSGNLAR | 3241 | QSSDLRR | 3741 | 0.008 |
| 1174 | GCTGAAGGG | 2242 | RSDHLSR | 2742 | QSSNLVR | 3242 | QSSDLRR | 3742 | 0.018 |
| 1175 | AAGGTCGCC | 2243 | DRSDLTR | 2743 | DPGALVR | 3243 | RSDNLTQ | 3743 | 8.9 |
| 1176 | GTGGGAGCC | 2244 | DRSDLTR | 2744 | QRAHLER | 3244 | RSDALTR | 3744 | 4.1 |
| 1177 | CCGGGCGCA | 2245 | QSGSLTR | 2745 | DRSHLAR | 3245 | RSDTLRE | 3745 | 4.1 |
| 1178 | GAGGATGGC | 2246 | DRSHLAR | 2746 | TSGNLVR | 3246 | RSDNLAR | 3746 | 0.085 |
| 1179 | GCAGCGCAG | 2247 | RSSNLRE | 2747 | RSSDLTR | 3247 | QSGSLTR | 3747 | 2.735 |
| 1180 | AAGGAAAGA | 2248 | QSGHLNQ | 2748 | QSGNLAR | 3248 | RSDNLTQ | 3748 | 4.825 |
| 1181 | TTGGCTATG | 2249 | RSDALRQ | 2749 | TSGELVR | 3249 | RGDALTS | 3749 | 8.2 |
| 1182 | CAGGAAGGC | 2250 | DRSHLAR | 2750 | QSGNLAR | 3250 | RSDNLRE | 3750 | 1.48 |
| 1183 | CAGGAAGGC | 2251 | DRSHLAR | 2751 | QSSNLVR | 3251 | RSDNLRE | 3751 | 1.935 |
| 1184 | AAGGAAAGA | 2252 | KNWKLQA | 2752 | QSGNLAR | 3252 | RSDNLTQ | 3752 | 2.785 |
| 1185 | AAGGAAAGA | 2253 | KNWKLQA | 2753 | QSHNLAR | 3253 | RSDNLTQ | 3753 | 5.25 |
| 1186 | GCCGAGGTG | 2254 | RSDSLLR | 2754 | RSKNLQR | 3254 | ERGTLAR | 3754 | 27.5 |
| 1187 | CTGGTGGGC | 2255 | DRSHLAR | 2755 | RSDALTR | 3255 | RSDALRE | 3755 | 0.006 |
| 1188 | GTAGTATGG | 2256 | RSDHLTT | 2756 | QSSSLVR | 3256 | QRASLAR | 3756 | 2.74 |
| 1189 | ATGGTTGAA | 2257 | QSANLAR | 2757 | TSGALTR | 3257 | RSDALRQ | 3757 | 1.51 |
| 1190 | ATGGCAGTG | 2258 | RSDALTR | 2758 | QSGDLTR | 3258 | RSDSLNQ | 3758 | 1.484 |
| 1191 | ATGGCAGTG | 2259 | RSDALTR | 2759 | QSGSLTR | 3259 | RSDSLNQ | 3759 | 5.325 |
| 1192 | ATGGCAGTG | 2260 | RSDALTR | 2760 | QSGDLTR | 3260 | RSDALTQ | 3760 | 2.364 |
| 1193 | ATGGCAGTG | 2261 | RSDALTR | 2761 | QSGSLTR | 3261 | RSDALTQ | 3761 | 3.125 |
| 1194 | GAGAAGGTG | 2262 | RSDALTR | 2762 | RSDNRTA | 3262 | RSDNLTR | 3762 | 2.19 |
| 1195 | GAGAAGGTG | 2263 | RSDALTR | 2763 | RSDNRTA | 3263 | RSSNLTR | 3763 | 2.8 |
| 1197 | GAAGGTGCC | 2264 | ERCDLTR | 2764 | MSHHLSR | 3264 | QSGNLTR | 3764 | 14.8 |
| 1199 | ATGGAGAAG | 2265 | RSDNRTA | 2765 | RSDNLTR | 3265 | RSDALTQ | 3765 | 3.428 |

TABLE 5-continued

| SBS# | TARGET | F1 | SEQ ID | F2 | SEQ ID | F3 | SEQ ID | Kd (Nm) |
|---|---|---|---|---|---|---|---|---|
| 1200 | ATGCAGAAG | RSDNRTA | 2266 | RSSNLTR | 2766 | RSDALTQ | 3266 | 16.87 |
| 1201 | ATGGAGAAG | RSDNRTA | 2267 | RSHNLTR | 2767 | RSDALTQ | 3267 | 14.8 |
| 1202 | CTGGAGTAC | DRSNLRT | 2268 | RSDNLTR | 2768 | RSDALRE | 3268 | 2.834 |
| 1203 | GGAGTACTG | RSDALRE | 2269 | QRSALAR | 2769 | QRAHLAR | 3269 | 2.945 |
| 1204 | GGAGTACTG | RSDALRE | 2270 | QSSSLVR | 2770 | QRAHLAR | 3270 | 4.38 |
| 1205 | CGGGCAGCT | QSSDLRR | 2271 | QSGDLTR | 2771 | RSDHLRE | 3271 | 0.9 |
| 1206 | GCGGGAGTT | TTSALTR | 2272 | QRAHLER | 2772 | RSDERKR | 3272 | 0.034 |
| 1207 | CAGGCTGGA | QRAHLER | 2273 | TSGELVR | 2773 | RSDNLRE | 3273 | 0.45 |
| 1209 | CCGGAAGCG | RSDELTR | 2274 | QSSNLVR | 2774 | RSDTLRE | 3274 | 19.28 |
| 1211 | GCAGCGCAG | RSDNLRE | 2275 | RSDELTR | 2775 | QSGSLTR | 3275 | 6.5 |
| 1212 | CAGGGGGTT | TTSALTR | 2276 | RSDHLTR | 2776 | RSDNLRE | 3276 | 0.05 |
| 1213 | GAAGAAGAG | RSDNLTR | 2277 | QSSNLVR | 2777 | QSGNLTR | 3277 | 12.3 |
| 1214 | ATGGGAGTT | TTSALTR | 2278 | QRAHLER | 2778 | RSDALTQ | 3278 | 0.46 |
| 1215 | GTGGGGGCT | QSSDLRR | 2279 | RSDHLTR | 2779 | RSDALTR | 3279 | 0.003 |
| 1217 | GAAGAGGCA | QSGSLTR | 2280 | RSDNLTR | 2780 | QSANLTR | 3280 | 0.004 |
| 1218 | GCGGTGAGG | RSDHLTQ | 2281 | RSQALTR | 2781 | RSDERKR | 3281 | 0.46 |
| 1219 | AAGGAAAGG | RSDHLTQ | 2282 | QSHNLAR | 2782 | RSDNLTQ | 3282 | 0.68 |
| 1220 | AAGGAAAGG | RSDHLTQ | 2283 | QSGNLAR | 2783 | RSDNLTQ | 3283 | 0.175 |
| 1221 | AAGGAAAGG | RSDHLTQ | 2284 | QSSNLVR | 2784 | RSDNLTQ | 3284 | 1.4 |
| 1222 | CAGGAGGGC | DRSHLAR | 2285 | RSDNLAR | 2785 | RSDNLRE | 3285 | 0.155 |
| 1223 | ATGGACTTG | RSDALTK | 2286 | DRSNLTR | 2786 | RSDALTQ | 3286 | 7 |
| 1224 | ATGGACTTG | RADALMV | 2287 | DRSNLTR | 2787 | RSDALTQ | 3287 | 12 |
| 1227 | GAATAGGGG | RSDHLSR | 2288 | RSDHLTK | 2788 | QSGNLAR | 3288 | 25 |
| 1228 | ACGGCCGAG | RSDNLAR | 2289 | DRSDLTR | 2789 | RSDDLTQ | 3289 | 12 |
| 1229 | AAGGGTGCG | RSDELTR | 2290 | MSHHLSR | 2790 | RSDNLTQ | 3290 | 8.2 |
| 1230 | AAGGGAGAC | DRSNLTR | 2291 | QSGHLTR | 2791 | RSDNLTQ | 3291 | 0.383 |
| 1231 | AAGGGAGAC | DRSNLTR | 2292 | QRAHLER | 2792 | RSDNLTQ | 3292 | 0.213 |
| 1232 | TGGGACCTG | RSDALRE | 2293 | DRSNLTR | 2793 | RSDHLTT | 3293 | 0.113 |
| 1233 | TGGGACCTG | RSDALRE | 2294 | DRSNLTR | 2794 | RSDHLTT | 3294 | 0.635 |
| 1234 | GAGTAGGCA | QSGSLTR | 2295 | RSDNLTK | 2795 | RSDNLAR | 3295 | 0.101 |
| 1236 | GAGTAGGCA | QSGSLTR | 2296 | RSDHLTT | 2796 | RSDNLAR | 3296 | 0.065 |
| 1237 | GAAGGAGAG | RSDNLAR | 2297 | QRAHLER | 2797 | QSGNLAR | 3297 | 0.065 |
| 1238 | CTGGATGTT | QSSALAR | 2298 | TSGNLVR | 2798 | RSDALRE | 3298 | 0.313 |
| 1239 | CAGGACGTG | RSDALTR | 2299 | DPGNLVR | 2799 | RSDNLKD | 3299 | 0.144 |
| 1240 | GGGGAGGCA | QSGSLTR | 2300 | RSDNLTR | 2800 | RSDHLSR | 3300 | 0.056 |
| 1241 | GAGGTGTCA | QSHDLTK | 2301 | RSDALAR | 2801 | RSDNLAR | 3301 | 0.027 |
| 1242 | GGGGTTGAA | QSMJLAR | 2302 | TSGSLTR | 2802 | RSDHLSR | 3302 | 0.02 |
| 1243 | GGGGTTGAA | QSANLAR | 2303 | QSSALTR | 2803 | RSDHLSR | 3303 | 0.101 |

TABLE 5-continued

| SBS# | TARGET | SEQ ID | F1 | SEQ ID | F2 | SEQ ID | F3 | SEQ ID | Kd (Nm) |
|---|---|---|---|---|---|---|---|---|---|
| 1244 | GTCGCGGTG | 2304 | RSDALTR | 2804 | RSDELQR | 3304 | DRSALAR | 3804 | 0.044 |
| 1245 | GTCGCGGTG | 2305 | RSDALTR | 2805 | RSDELQR | 3305 | DSGSLTR | 3805 | 0.102 |
| 1246 | GTGGTTGCG | 2306 | RSDELTR | 2806 | TSGSLTR | 3306 | RSDALTR | 3806 | 0.051 |
| 1247 | GTGGTTGCG | 2307 | RSDELTR | 2807 | TSGALTR | 3307 | RSDALTR | 3807 | 0.117 |
| 1248 | GTCTAGGTA | 2308 | QSGALTR | 2808 | RSDNLTT | 3308 | DRSALAR | 3808 | 5.14 |
| 1249 | CCGGGAGCG | 2309 | RSDELTR | 2809 | QSGHLTR | 3309 | RSDTLRE | 3809 | 0.26 |
| 1250 | GAAGGAGAG | 2310 | RSDNLAR | 2810 | QSGHLTR | 3310 | QSGNLAR | 3810 | 0.31 |
| 1252 | CCGGCTGGA | 2311 | QRAHLER | 2811 | QSSDLTR | 3311 | RSDTLRE | 3811 | 0.153 |
| 1253 | CCGGGAGCG | 2312 | RSDELTR | 2812 | QRAHLER | 3312 | RSDTLRE | 3812 | 0.228 |
| 1255 | ACGTAGTAG | 2313 | RSDNLTT | 2813 | RSDNLTK | 3313 | RSDTLKQ | 3813 | 0.69 |
| 1256 | GGGGAGGAT | 2314 | QSSNLAR | 2814 | RSDNLQR | 3314 | RSDHLSR | 3814 | 2 |
| 1257 | GGGGAGGAT | 2315 | TTSNLAR | 2815 | RSDNLQR | 3315 | RSDHLSR | 3815 | 1 |
| 1258 | GGGGAGGAT | 2316 | QSSNLRR | 2816 | RSDNLQR | 3316 | RSDHLSR | 3816 | 2 |
| 1259 | GAGTGTGTG | 2317 | RSDSLLR | 2817 | DRDHLTR | 3317 | RSDNLAR | 3817 | 1.5 |
| 1260 | GAGTGTGTG | 2318 | RLDSLLR | 2818 | DRDHLTR | 3318 | RSDNLAR | 3818 | 1.8 |
| 1261 | TGCGGGCA | 2319 | QSGDLTR | 2819 | RSDHLTR | 3319 | RRDTLHR | 3819 | 0.2 |
| 1262 | TGCGGGCA | 2320 | QSGDLTR | 2820 | RSDHLTR | 3320 | RLDTLGR | 3820 | 3 |
| 1263 | TGCGGGCA | 2321 | QSGDLTR | 2821 | RSDHLTR | 3321 | DSGHLAS | 3821 | 21 |
| 1264 | AAGTTGGTT | 2322 | TTSALTR | 2822 | RADALMV | 3322 | RSDNLTQ | 3822 | 0.21 |
| 1265 | AAGTTGGTT | 2323 | TTSALTR | 2823 | RSDALTT | 3323 | RSDNLTQ | 3823 | 0.077 |
| 1266 | CAGGGTGGC | 2324 | DRSHLTR | 2824 | QSSHLAR | 3324 | RSDNLRE | 3824 | 6.1 |
| 1267 | TAGGCAGTC | 2325 | DRSALTR | 2825 | QSGSLTR | 3325 | RSDNLTT | 3825 | 6 |
| 1268 | CTGTTGGCT | 2326 | QSSDLTR | 2826 | RADALMV | 3326 | RSDALRE | 3826 | 1.52 |
| 1269 | CTGTTGGCT | 2327 | QSSDLTR | 2827 | RSDALTT | 3327 | RSDALRE | 3827 | 12.3 |
| 1270 | TTGGATGGA | 2328 | QSGHLAR | 2828 | TSGNLVR | 3328 | RSDALTK | 3828 | 0.4 |
| 1271 | GTGGCACTG | 2329 | RSDALRE | 2829 | QSGSLTR | 3329 | RSDALTR | 3829 | 0.915 |
| 1272 | CAGGAGTCC | 2330 | DRSSLTT | 2830 | RSDNLAR | 3330 | RSDNLRE | 3830 | 0.04 |
| 1273 | CAGGAGTCC | 2331 | ERGDLTT | 2831 | RSDNLAR | 3331 | RSDNLRE | 3831 | 0.1 |
| 1274 | GCATGGGAA | 2332 | QSANLSR | 2832 | RSDHLTT | 3332 | QSGSLTR | 3832 | 0.306 |
| 1275 | GCATGGGAA | 2333 | QRSNLVR | 2833 | RSDHLTT | 3333 | QSGSLTR | 3833 | 0.326 |
| 1276 | TAGGAAGAG | 2334 | RSDNLAR | 2834 | QRSNLVR | 3334 | RSDNLTT | 3834 | 0.685 |
| 1277 | GAAGAGGGG | 2335 | RSDHLAR | 2835 | RSDNLAR | 3335 | QSGNLTR | 3835 | 0.421 |
| 1278 | GAGTAGGCA | 2336 | QSGSLTR | 2836 | RSDNLRT | 3336 | RSDNLAR | 3836 | 0.019 |
| 1279 | GAGGTGTCA | 2337 | QSGDLRT | 2837 | RSDALAR | 3337 | RSDNLAR | 3837 | 0.025 |
| 1282 | TCGGTCGCC | 2338 | ERGDLTR | 2838 | DPGALVR | 3338 | RSDELRT | 3838 | 74.1 |
| 1287 | GTGGTAGGA | 2339 | QSGHLAR | 2839 | QSGALAR | 3339 | RSDALTR | 3839 | 0.152 |
| 1288 | CAGGGTGGC | 2340 | DRSHLTR | 2840 | QSSHLAR | 3340 | RSDNLTE | 3840 | 4.1 |
| 1289 | TAGGCAGTC | 2341 | DRSALTR | 2841 | QSGSLTR | 3341 | RSDNLTK | 3841 | 1.37 |

TABLE 5-continued

| SBS# | TARGET | SEQ ID F1 | SEQ ID | F2 | SEQ ID | F3 | SEQ ID | Kd (Nm) |
|---|---|---|---|---|---|---|---|---|
| 1290 | GTGGTGATA | QSGALTQ | 2342 | RSHALTR | 2842 | RSDALTR | 3342 | 24.05 |
| 1291 | GTGGTGATA | QQASLNA | 2343 | RSHALTR | 2843 | RSDALTR | 3343 | 20.55 |
| 1292 | TTGGATGGA | QSGHLAR | 2344 | TSGNLVR | 2844 | RSDALTT | 3344 | 4.12 |
| 1293 | AAGGTAGGT | TSGHLVR | 2345 | QSGALAR | 2845 | RSDNLTQ | 3345 | 0.457 |
| 1294 | AAGGTAGGT | MSHHLSR | 2346 | QSGALAR | 2846 | RSDNLTQ | 3346 | 2.75 |
| 1295 | CAGGAGTCC | DRSSLTT | 2347 | RSDNLAR | 2847 | RSDNLTE | 3347 | 0.116 |
| 1296 | CAGGAGTCC | ERGDLTT | 2348 | RSDNLAR | 2848 | RSDNLTE | 3348 | 37 |
| 1297 | TAGGAAGAG | RSDNLAR | 2349 | QRSNLVR | 2849 | RSDNLTK | 3349 | 0.05 |
| 1298 | CAGGACGTG | RSDLATR | 2350 | DPGNLVR | 2850 | RSDNLTE | 3350 | 0.05 |
| 1300 | GTCTAGGTA | QSGALTR | 2351 | RSDNLTK | 2851 | DRSALAR | 3351 | 0.46 |
| 1302 | CCGGCTGGA | QSGHLTR | 2352 | QSSDLTR | 2852 | RSDTLRE | 3352 | 0.05 |
| 1303 | TAGGAGTTT | QRSALAS | 2353 | RSDNLAR | 2853 | RSDNLTT | 3353 | 0.088 |
| 1306 | CTGGCCTTG | RSDALTT | 2354 | DCRDLAR | 2854 | RSDALRE | 3354 | 2.285 |
| 1308 | TGGGCAGCC | ERGTLAR | 2355 | QSGSLTR | 2855 | RSDHLTT | 3355 | 0.305 |
| 1309 | TAGGAGTTT | QSSALAS | 2356 | RSDNLAR | 2856 | RSDNLTT | 3356 | 0.184 |
| 1310 | TAGGAGTTT | TTSALAS | 2357 | RSDNLAR | 2857 | RSDNLTT | 3357 | 0.075 |
| 1311 | TGGGCAGCC | ERGDLAR | 2358 | QSGSLTR | 2858 | RSDHLTT | 3358 | 0.91 |
| 1312 | GGGGCGTGA | QSGHLTK | 2359 | RSDELQR | 2859 | RSDHLSR | 3359 | 0.23 |
| 1313 | GGGGCGTGA | QSCHLTT | 2360 | RSDELQR | 2860 | RSDHLSR | 3360 | 0.09 |
| 1314 | GTACAGTAG | RSDNLTT | 2361 | RSDNLRE | 2861 | QSSSLVR | 3361 | 3.09 |
| 1315 | GTACAGTAG | RSDNLTT | 2362 | RSDNLTE | 2862 | QSSSLVR | 3362 | 9.27 |
| 1318 | ATGGTGTGT | TSSHLAS | 2363 | RSDALAR | 2863 | RSDALAQ | 3363 | 0.048 |
| 1319 | ATGGTGTGT | MSHHLTT | 2364 | RSDALAR | 2864 | RSDALAQ | 3364 | 0.228 |
| 1320 | TTGGGAGAG | RSDNLAR | 2365 | QPAHLER | 2865 | RSDALTT | 3365 | 0.044 |
| 1321 | TTGGGAGAG | RSDNLAR | 2366 | QRAHLER | 2866 | RADALMV | 3366 | 0.127 |
| 1322 | GTGGGAATA | QSGALTQ | 2367 | QSGHLTR | 2867 | RSDALTR | 3367 | 0.799 |
| 1323 | GTGGGAATA | QLTGLNQ | 2368 | QSGHLTR | 2868 | RSDALTR | 3368 | 0.744 |
| 1324 | GTGGGAATA | QQASLNA | 2369 | QSHHLTR | 2869 | RSDALTR | 3369 | 18.52 |
| 1325 | TTGGTTGGT | TSGHLVR | 2370 | TSGSLTR | 2870 | RSDALTK | 3370 | 0.306 |
| 1326 | TTGGTTGGT | TSGHLVR | 2371 | QSSALTR | 2871 | RSDALTK | 3371 | 4.385 |
| 1327 | TTGGTTGGT | TSGHLVR | 2372 | TSGSLTR | 2872 | RSDALTT | 3372 | 0.566 |
| 1328 | TTGGTTGGT | TSGHLVR | 2373 | QSSALTR | 2873 | RSDALTT | 3373 | 7.95 |
| 1329 | CTGGCCTGG | RSDHLTT | 2374 | DRSDLTR | 2874 | RSDALRE | 3374 | 0.68 |
| 1330 | GAGGTGTGA | QSGHLTT | 2375 | RSDALTR | 2875 | RSDNLAR | 3375 | 0.175 |
| 1331 | CTGGCCTGG | RSDHLTT | 2376 | DCRDLAR | 2876 | RSDALRE | 3376 | 0.388 |
| 1334 | CCGGCGCTG | RSDALRE | 2377 | RSSDLTR | 2877 | RSDDLRE | 3377 | 0.31 |
| 1335 | GACGCTGGC | DRSHLTR | 2378 | QSSDLTR | 2878 | DSSNLTR | 3378 | 1.4 |
| 1336 | CGGGCTGGA | QSGHLAR | 2379 | QSSDLTR | 2879 | RSDHLAE | 3379 | 1.4 |

TABLE 5-continued

| SBS# | TARGET | SEQ ID | F1 | SEQ ID | F2 | SEQ ID | F3 | SEQ ID | Kd (Nm) |
|---|---|---|---|---|---|---|---|---|---|
| 1337 | CGGGCTGGA | 2380 | QSSHLAR | 2880 | QSSDLTR | 3380 | RSDHLAE | 3880 | 0.235 |
| 1338 | GGGATGGCG | 2381 | RSDELTR | 2881 | RSDALTQ | 3381 | RSDHLSR | 3881 | 1.04 |
| 1339 | GGGATGGCG | 2382 | RSDELTR | 2882 | RSDSLTQ | 3382 | RSDHLSR | 3882 | 0.569 |
| 1340 | GGGATGGCG | 2383 | RSDELTR | 2883 | RSDALTQ | 3383 | RSHHLSR | 3883 | 0.751 |
| 1341 | GGGATGGCG | 2384 | RSDELTR | 2884 | RSDSLTQ | 3384 | RSHHLSR | 3884 | 4.1 |
| 1342 | CAGGCGCAG | 2385 | RSDNLRE | 2885 | RSSDLTR | 3385 | RSDNLTE | 3885 | 0.68 |
| 1343 | CAGGCGCAG | 2386 | RSDNLTT | 2886 | RTSTLTR | 3386 | RSDNLTE | 3886 | 37.04 |
| 1344 | CCGGGCGAC | 2387 | DRSNLTR | 2887 | DRSHLAR | 3387 | RSDTLRE | 3887 | 2.28 |
| 1346 | GATGTGTGA | 2388 | QSGHLTT | 2888 | RSDALAR | 3388 | TSANLSR | 3888 | 0.153 |
| 1347 | CAGTGAATG | 2389 | RSDALTS | 2889 | QSHHLTT | 3389 | RSDNLTE | 3889 | 8.23 |
| 1348 | GGGTCACTG | 2390 | RSDALTA | 2890 | QAATLTT | 3390 | RSDHLSR | 3890 | 2.58 |
| 1350 | CAGTGAATG | 2391 | RSDALTQ | 2891 | QSGHLTT | 3391 | RSDNLTE | 3891 | 74.1 |
| 1351 | GGGTCACTG | 2392 | RSDALRE | 2892 | QSHDLTK | 3392 | RSDHLSR | 3892 | 0.234 |
| 1352 | GTGTGGGTC | 2393 | DRSALAR | 2893 | RSDHLTT | 3393 | RSDALTR | 3893 | 0.023 |
| 1353 | CTGGCGAGA | 2394 | QSGHLNQ | 2894 | RSDELQR | 3394 | RSDALRE | 3894 | 56.53 |
| 1354 | CTGGCGAGA | 2395 | KNWKLQA | 2895 | RSDELQR | 3395 | RSDALRE | 3895 | 20.85 |
| 1355 | GCTTTGGCA | 2396 | QSGSLTR | 2896 | RSDALTT | 3396 | QSSDLTR | 3896 | 0.172 |
| 1356 | GCTTTGGCA | 2397 | QSGSLTR | 2897 | RADALMV | 3397 | QSSDLTR | 3897 | 0.034 |
| 1357 | GACTTGGTA | 2398 | QSSSLVR | 2898 | RSDALTT | 3398 | DRSNLTR | 3898 | 0.032 |
| 1358 | GACTTGGTA | 2399 | QSSSLVR | 2899 | RADALMV | 3399 | DRSNLTR | 3899 | 0.05 |
| 1360 | CAGTTGTGA | 2400 | QSGHLTT | 2900 | RADALMV | 3400 | RSDNLTE | 3900 | 41.7 |
| 1361 | AAGGAAAAA | 2401 | QKTNLDT | 2901 | QSGNLQR | 3401 | RSDNLTQ | 3901 | 0.835 |
| 1362 | AAGGAAAAA | 2402 | QSGNLNQ | 2902 | QSGNLQR | 3402 | RSDNLTQ | 3902 | 0.332 |
| 1363 | AAGGAAAAA | 2403 | QKTNLDT | 2903 | QRSNLVR | 3403 | RSDNLTQ | 3903 | 74.1 |
| 1364 | ATGGGTGAA | 2404 | QSANLSR | 2904 | QSSHLAR | 3404 | RSDALAQ | 3904 | 1.22 |
| 1365 | ATGGGTGAA | 2405 | QRSNLVR | 2905 | QSSHLAR | 3405 | RSDALAQ | 3905 | 0.152 |
| 1366 | ATGGGTGAA | 2406 | QSANLSR | 2906 | TSGHLVR | 3406 | RSDALAQ | 3906 | 22.63 |
| 1367 | ATGGGTGAA | 2407 | QRSNLVR | 2907 | TSGHLVR | 3407 | RSDALAQ | 3907 | 1.028 |
| 1368 | CTGGGAGAT | 2408 | QSSNLAR | 2908 | QRAHLER | 3408 | RSDALRE | 3908 | 0.051 |
| 1369 | CTGGGAGAT | 2409 | QSSNLAR | 2909 | QSGHLTR | 3409 | RSDALRE | 3909 | 0.227 |
| 1373 | GTGGTGGGC | 2410 | DRSHLTR | 2910 | RSDALSR | 3410 | RSDALTR | 3910 | 0.025 |
| 1374 | CCGGCGGTG | 2411 | RSDALTR | 2911 | RSDELQR | 3411 | RSDELRE | 3911 | 0.003 |
| 1375 | CCGGCGGTG | 2412 | RSDALTR | 2912 | RSDDLQR | 3412 | RSDELRE | 3912 | 0.008 |
| 1376 | CCGGCGGTG | 2413 | RSDALTR | 2913 | RSDERKR | 3413 | RSDELRE | 3913 | 0.858 |
| 1377 | CCGGCGGTG | 2414 | RSDALTR | 2914 | RSDELQR | 3414 | RSDDLRE | 3914 | 0.012 |
| 1378 | CCGGCGGTG | 2415 | RSDALTR | 2915 | RSDDLQR | 3415 | RSDDLRE | 3915 | 0.012 |
| 1379 | CCGGCGGTG | 2416 | RSDALTR | 2916 | RSDERKR | 3416 | RSDDLRE | 3916 | 0.25 |
| 1380 | GCCGACGGT | 2417 | QSSHLTR | 2917 | DRSNLTR | 3417 | ERGDLTR | 3917 | 0.076 |

TABLE 5-continued

| SBS# | TARGET | SEQ ID | F1 | SEQ ID | F2 | SEQ ID | F3 | SEQ ID | Kd (Nm) |
|---|---|---|---|---|---|---|---|---|---|
| 1381 | GCCGACGGT | 2418 | QSSHLTR | 2918 | DPGNLVR | 3418 | ERGDLTR | 3918 | 0.23 |
| 1382 | GCCGACGGT | 2419 | QSSHLTR | 2919 | DRSNLTR | 3419 | DCRDLAR | 3919 | 3.1 |
| 1383 | GCCGACGGT | 2420 | QSSHLTR | 2920 | DPGNLVR | 3420 | DGRDLAR | 3920 | 1.74 |
| 1384 | GGTGTGGGC | 2421 | DRSHLTR | 2921 | RSDALSR | 3421 | MSHHLSR | 3921 | 0.013 |
| 1385 | TGGGCAAGA | 2422 | QSGHLNQ | 2922 | QSGSLTR | 3422 | RSDHLTT | 3922 | 0.229 |
| 1386 | TGGGCAAGA | 2423 | ENWKLQA | 2923 | QSGSLTR | 3423 | RSDHLTT | 3923 | 0.193 |
| 1389 | CTGGCCTGG | 2424 | RSDHLTT | 2924 | DCRDLAR | 3424 | RSDALRE | 3924 | 0.175 |
| 1393 | TGGGAAGCT | 2425 | QSSDLRR | 2925 | QSGNLAR | 3425 | RSDHLTT | 3925 | 0.1 |
| 1394 | TGGGAAGCT | 2426 | QSSDLRR | 2926 | QSGNLAR | 3426 | RSDHLTK | 3926 | 0.04 |
| 1395 | GAAGAGGGA | 2427 | QSGHLQR | 2927 | RSDNLAR | 3427 | QSGNLAR | 3927 | 0.025 |
| 1396 | GAAGAGGGA | 2428 | QRAHLAR | 2928 | RSDNLAR | 3428 | QSGNLAR | 3928 | 0.107 |
| 1397 | GAAGAGGGA | 2429 | QSSHLAR | 2929 | RSDNLAR | 3429 | QSGNLAR | 3929 | 0.14 |
| 1398 | TAATGGGGG | 2430 | RSDHLSR | 2930 | RSDHLTT | 3430 | QSGNLRT | 3930 | 0.065 |
| 1399 | TGGGAGTGT | 2431 | TKQHLKT | 2931 | RSDNLAR | 3431 | RSDHLTT | 3931 | 0.1 |
| 1400 | CCGGGTGAG | 2432 | RSDNLAR | 2932 | QSSHLAR | 3432 | RSDDLRE | 3932 | 0.371 |
| 1401 | GAGTTGGCC | 2433 | ERGTLAR | 2933 | RADALMV | 3433 | RSDNLAR | 3933 | 0.167 |
| 1402 | CTGGAGTTG | 2434 | RGDALTS | 2934 | RSDNLAR | 3434 | RSDALRE | 3934 | 0.15 |
| 1403 | ATGGCAATG | 2435 | RSDALTQ | 2935 | QSGSLTR | 3435 | RSDALTQ | 3935 | 0.07 |
| 1404 | GAGGCAGGG | 2436 | RSDHLSR | 2936 | QSGSLTR | 3436 | RSDNLAR | 3936 | 0.022 |
| 1405 | GAGGCAGGG | 2437 | RSDHLSR | 2937 | QSGDLTR | 3437 | RSDNLAR | 3937 | 0.045 |
| 1406 | GAAGCGGAG | 2438 | RSDNLAR | 2938 | RSDELTR | 3438 | QSGNLAR | 3938 | 0.025 |
| 1407 | GCGGGCGCA | 2439 | QSGSLTR | 2939 | DRSHLAR | 3439 | RSDERKR | 3939 | 0.585 |
| 1408 | CCGGCAGGG | 2440 | RSDHLSR | 2940 | QSGSLTR | 3440 | RSDELRE | 3940 | 0.305 |
| 1409 | CCGGCAGGG | 2441 | RSDHLSR | 2941 | QSGSLTR | 3441 | RSDDLRE | 3941 | 0.153 |
| 1410 | CCGGCGGCG | 2442 | RSDELTR | 2942 | RSDELQR | 3442 | RSDELRE | 3942 | 0.814 |
| 1411 | TGAGGCGAG | 2443 | RSDNLAR | 2943 | DRSHLAR | 3443 | QSGHLTK | 3943 | 0.282 |
| 1412 | CTGGCCGTG | 2444 | RSDSLLR | 2944 | ERGTLAR | 3444 | RSDALRE | 3944 | 0.172 |
| 1413 | CTGGCCGCG | 2445 | RSDELTR | 2945 | DRSDLTR | 3445 | RSDALRE | 3945 | 0.152 |
| 1414 | CTGGCCGCG | 2446 | RSDELTR | 2946 | ERGTLAR | 3446 | RSDALRE | 3946 | 0.914 |
| 1415 | GCGGCCGAG | 2447 | RSDNLAR | 2947 | DRSDLTR | 3447 | RSDELQR | 3947 | 0.102 |
| 1416 | GCGGCCGAG | 2448 | RSDNLAR | 2948 | ERGTLAR | 3448 | RSDELQR | 3948 | 0.153 |
| 1417 | GAGTTGGCC | 2449 | ERGTLAR | 2949 | RGDALTS | 3449 | RSDNLAR | 3949 | 1.397 |
| 1418 | CTGGAGTTG | 2450 | RADALMV | 2950 | RSDNLAR | 3450 | RSDALRE | 3950 | 0.241 |
| 1422 | GGGTCGGCG | 2451 | RSDELTR | 2951 | RSDDLTT | 3451 | RSDHLSR | 3951 | 0.064 |
| 1423 | GGGTCGGCG | 2452 | RSDELTR | 2952 | RSDDLTK | 3452 | RSDHLSR | 3952 | 0.034 |
| 1424 | CAGGGCCCG | 2453 | RSDELRE | 2953 | DRSHLAR | 3453 | RSDNLRE | 3953 | 1.37 |
| 1427 | CAGGGCCCG | 2454 | RSDDLRE | 2954 | DRSHLAR | 3454 | RSDNLTE | 3954 | 0.271 |
| 1428 | TGAGGCGAG | 2455 | RSDNLAR | 2955 | DRSHLAR | 3455 | QSVHLQS | 3955 | 0.102 |

TABLE 5-continued

| SBS# | TARGET | SEQ ID | F1 | SEQ ID | F2 | SEQ ID | F3 | SEQ ID | Kd (Nm) |
|---|---|---|---|---|---|---|---|---|---|
| 1429 | TGAGGCGAG | 2456 | RSDNLAR | 2956 | DRSHLAR | 3456 | QSGHLTT | 3956 | 0.074 |
| 1430 | TCGGCCGCC | 2457 | ERGTLAR | 2957 | DRSDLTR | 3457 | RSDDLTK | 3957 | 0.352 |
| 1431 | TCGGCCGCC | 2458 | ERGTLAR | 2958 | DRSDLTR | 3458 | RSDDLAS | 3958 | 6.17 |
| 1432 | TCGGCCGCC | 2459 | ERGTLAR | 2959 | ERGTLAR | 3459 | RSDDLTK | 3959 | 1.778 |
| 1434 | CTGGCCGTG | 2460 | RSDSLLR | 2960 | DRSDLTR | 3460 | RSDALRE | 3960 | 0.051 |
| 1435 | TAATGGGGG | 2461 | RSDHLSR | 2961 | RSDHLTT | 3461 | QSGNLTK | 3961 | 0.057 |
| 1436 | TGGGAGTGT | 2462 | TSDHLAS | 2962 | RSDNLAR | 3462 | RSDHLTT | 3962 | 0.026 |
| 1439 | GGAGTGTTA | 2463 | QRSALAS | 2963 | RSDALAR | 3463 | QSGHLQR | 3963 | 0.075 |
| 1440 | GGAGTGTTA | 2464 | QSGALTK | 2964 | RSDALAR | 3464 | QSGHLQR | 3964 | 0.035 |
| 1441 | ATAGCTGGG | 2465 | RSDHLSR | 2965 | QSSDLTR | 3465 | QSGALTQ | 3965 | 0.262 |
| 1442 | TGCTGGGCC | 2466 | ERGTLAR | 2966 | RSDHLTT | 3466 | DRSHLTK | 3966 | 0.36 |
| 1443 | TGGAAGGAA | 2467 | QSGNLAR | 2967 | RSDNLTQ | 3467 | RSHHLTT | 3967 | 0.22 |
| 1444 | TGGAAGGAA | 2468 | QSGNLAR | 2968 | RSDNLTQ | 3468 | RSSHLTT | 3968 | 0.09 |
| 1445 | TGGAAGCAA | 2469 | QSGNLAR | 2969 | RLDNLTA | 3469 | RSHHLTT | 3969 | 0.182 |
| 1446 | TGGAAGGAA | 2470 | QSGNLAR | 2970 | RLDNLTA | 3470 | RSSHLTT | 3970 | 0.42 |
| 1454 | GGAGAGGCT | 2471 | QSSDLRR | 2971 | RSDNLAR | 3471 | QSGHLQR | 3971 | 0.01 |
| 1455 | CGGGATGAA | 2472 | QSANLSR | 2972 | TSGNLVR | 3472 | RSDHLRE | 3972 | 0.043 |
| 1456 | GGAGAGGCT | 2473 | QSSDLRR | 2973 | RSDNLAR | 3473 | QRAHLAR | 3973 | 0.016 |
| 1457 | GCAGAGGAA | 2474 | QSANLSR | 2974 | RSDNLAR | 3474 | QSGSLTR | 3974 | 0.014 |
| 1460 | TTGGGGGAG | 2475 | RSDNLAR | 2975 | RSDHLTR | 3475 | RADALMV | 3975 | 0.007 |
| 1461 | GACGAGGAG | 2476 | RSANLAR | 2976 | RSDNLTR | 3476 | DRSNLTR | 3976 | 0.014 |
| 1462 | CGGGATGAA | 2477 | QSGNLAR | 2977 | TSGNLVR | 3477 | RSDHLRE | 3977 | 0.05 |
| 1463 | GAGGCTGTT | 2478 | TTSALTR | 2978 | QSSDLTR | 3478 | RSDNLAR | 3978 | 0.003 |
| 1464 | GACGAGGAG | 2479 | RSDNLAR | 2979 | RSDNLTR | 3479 | DRSNLTR | 3979 | 0.002 |
| 1465 | CTGGGAGTT | 2480 | TTSALTR | 2980 | QSGHLQR | 3480 | RSDALRE | 3980 | 0.018 |
| 1466 | CTGGGAGTT | 2481 | NRATLAR | 2981 | QSGHLQR | 3481 | RSDALRE | 3981 | 0.017 |
| 1468 | GGTGATGTC | 2482 | DRSALTR | 2982 | TSGNLVR | 3482 | MSHHLSR | 3982 | 0.08 |
| 1469 | GGTGATGTC | 2483 | DRSALTR | 2983 | TSGNLVR | 3483 | TSGHLVR | 3983 | 0.28 |
| 1470 | GGTGATGTC | 2484 | DRSALTR | 2984 | TSGNLVR | 3484 | QRAHLER | 3984 | 0.156 |
| 1471 | CTGGTTGGG | 2485 | RSDHLSR | 2985 | QSSALTR | 3485 | RSDALRE | 3985 | 0.09 |
| 1472 | TTGAAGGTT | 2486 | TTSALTR | 2986 | RSDNLTQ | 3486 | RADALMV | 3986 | 3.22 |
| 1473 | TTGAAGGTT | 2487 | TTSALTR | 2987 | RSDNLTQ | 3487 | RSDSLTT | 3987 | 0.47 |
| 1474 | TTGAAGGTT | 2488 | QSSALAR | 2988 | RSDNLTQ | 3488 | RADALMV | 3988 | 1.39 |
| 1475 | TTGAAGGTT | 2489 | QSSALAR | 2989 | RSDNLTQ | 3489 | RLHSLTT | 3989 | 0.39 |
| 1476 | TTGAAGGTT | 2490 | QSSALAR | 2990 | RSDNLTQ | 3490 | RSDSLTT | 3990 | 0.305 |
| 1477 | GCAGCCCGG | 2491 | RSDHLRE | 2991 | DRSDLTR | 3491 | QSGSLTR | 3991 | 2.31 |
| 1479 | GAAAGTTCA | 2492 | QSHDLTK | 2992 | MSHHLTQ | 3492 | QSGNLAR | 3992 | 37.04 |
| 1480 | GAAAGTTCA | 2493 | NKTDLGK | 2993 | TSGHLVQ | 3493 | QSGNLAR | 3993 | 62.5 |

TABLE 5-continued

| SBS# | TARGET | SEQ ID F1 | | SEQ ID F2 | | SEQ ID F3 | | SEQ ID | Kd (Nm) |
|---|---|---|---|---|---|---|---|---|---|
| 1481 | GAAAGTTCA | 2494 | NKTDLGK | 2994 | TSDHLAS | 3494 | RSDELRE | 3994 | 37.04 |
| 1482 | CCGTGTGAC | 2495 | DRSNLTR | 2995 | TSDHLAS | 3495 | RSDELRE | 3995 | 111.1 |
| 1483 | CCGTGTGAC | 2496 | DRSNLTR | 2996 | MSHHLTT | 3496 | RSDELRE | 3996 | 20.8 |
| 1484 | GAAGTGGTA | 2497 | QSSSLVR | 2997 | RSDALSR | 3497 | QSGNLAR | 3997 | 0.01 |
| 1485 | AAGTGAGCT | 2498 | QSSDLRR | 2998 | QSGHLTT | 3498 | RSDNLTQ | 3998 | 1.537 |
| 1486 | GGGTTTGAC | 2499 | DRSNLTR | 2999 | TTSALAS | 3499 | RSDHLSR | 3999 | 0.085 |
| 1487 | TTGAAGGTT | 2500 | TTSALTR | 3000 | RSDNLTQ | 3500 | RLHSLTT | 4000 | 0.188 |
| 1488 | AAGTGGTAG | 2501 | QSSDLRR | 3001 | QSGHLTT | 3501 | RLDNRTQ | 4001 | 5.64 |
| 1490 | CTGGTTGGC | 2502 | RSDHLSR | 3002 | TSGSLTR | 3502 | RSDALRE | 4002 | 0.04 |
| 1491 | AAGGGTTCA | 2503 | NKTDLGK | 3003 | DSSKLSR | 3503 | RLDNRTA | 4003 | 4.12 |
| 1492 | AAGTGGTAG | 2504 | RSDNLTT | 3004 | RSDHLTT | 3504 | RSDNLTQ | 4004 | 1.37 |
| 1493 | AAGTGGTAC | 2505 | RSDNLTT | 3005 | RSDHLTT | 3505 | RLDNRTQ | 4005 | 15.09 |
| 1494 | GGGTTTGAC | 2506 | DRSNLTR | 3006 | QRSALAS | 3506 | RSDHLSR | 4006 | 0.255 |
| 1496 | TTGGGGGAG | 2507 | RSDNLAR | 3007 | RSDHLTR | 3507 | RSDALTT | 4007 | 0.065 |
| 1497 | GAGGCTCTT | 2508 | QSSALAR | 3008 | QSSDLTR | 3508 | RSDNLAR | 4008 | 0.007 |
| 1498 | GAGGTTGAT | 2509 | QSSNLAR | 3009 | QSSALTR | 3509 | RSDNLAR | 4009 | 0.101 |
| 1499 | GAGGTTGAT | 2510 | QSSNLAR | 3010 | TSGALTR | 3510 | RSDNLAR | 4010 | 0.02 |
| 1500 | GCAGAGGAA | 2511 | QSGNLAR | 3011 | RSDNLAR | 3511 | QSGSLTR | 4011 | 0.003 |
| 1522 | GCAATGGGT | 2512 | TSGHLVR | 3012 | RSDALTQ | 3512 | QSGDLTR | 4012 | 0.08 |

TABLE 6

| TRIPLET (5'→3') | FINGER (N → C) | | | | | |
|---|---|---|---|---|---|---|
| | F1 | SEQ ID NO: | F2 | SEQ ID NO: | F3 | SEQ ID NO: |
| AGG | | | | | RXDHXXQ | 4055 |
| ATG | | | | | RXDAXXQ | 4056 |
| CGG | | | | | RXDHXXE | 4057 |
| GAA | | | QXGNXXR | 4058 | | |
| GAC | DXSNXXR | 4059 | | | DXSNXXR | 4059 |
| GAG | RXDNXXR | 4060 | RXSNXXR | 4061 | RXDNXXR | 4060 |
| | | | RXDNXXR | 4060 | | |
| GAT | QXSNXXR | 4062 | TXGNXXR | 4064 | | |
| | TXSNXXR | 4063 | | | | |
| | TXGNXXR | 4064 | | | | |
| GCA | QXGSXXR | 4065 | QXGDXXR | 4066 | | |
| GCC | EXGTXXR | 4067 | | | | |
| GCG | RXDEXXR | 4068 | RXDEXXR | 4068 | RXDEXXR | 4068 |
| | | | | | RXDTXXK | 4069 |
| GCT | QXSDXXR | 4070 | TXGEXXR | 4071 | | |
| | | | QXSDXXR | 4070 | | |
| GGA | | | QXGHXXR | 4072 | QXAHXXR | 4073 |
| GGC | | | DXSHXXR | 4074 | DXSHXXR | 4074 |
| GGG | | | RXDHXXR | 4075 | RXDHXXR | 4075 |
| | | | | | RXDHXXK | 4076 |
| GGT | | | | | TXGHXXR | 4077 |
| GTA | | | QXGSXXR | 4065 | | |
| | | | QXATXXR | 4078 | | |

TABLE 6-continued

| TRIPLET (5'→3') | FINGER (N → C) | | | | | |
|---|---|---|---|---|---|---|
| | F1 | SEQ ID NO: | F2 | SEQ ID NO: | F3 | SEQ ID NO: |
| GTG | RXDAXXR | 4079 | RXDAXXR | 4079 | RXDAXXR | 4079 |
| | RXDSXXR | 4080 | | | | |
| TAG | | | RXDNXXT | 4081 | | |

TABLE 6-continued

| TRIPLET (5'→3') | FINGER (N → C) | | | | | |
|---|---|---|---|---|---|---|
| | F1 | SEQ ID NO: | F2 | SEQ ID NO: | F3 | SEQ ID NO: |
| TCG | RXDDXXK | 4082 | | | | |
| TGT | | | | | TXDHXXS | 4083 |

SEQUENCE LISTING (4085 sequences)

SEQ ID NO: 1 - protein, 25 aa, Artificial Sequence
  Description of Artificial Sequence: exemplary motif
  MOD_RES (2)..(5): this region may encompass two to four residues consisting of any amino acid
  MOD_RES (7)..(18): any amino acid
  MOD_RES (20)..(24): this region may encompass three to five residues consisting of any amino acid
CXXXXCXXXXXXXXXXXXHXXXXXH

SEQ ID NO: 2 - protein, 5 aa, Artificial Sequence
  Description of Artificial Sequence: peptide linker
TGEKP

SEQ ID NO: 3 - protein, 5 aa, Artificial Sequence
  Description of Artificial Sequence: peptide linker
GGGGS

SEQ ID NO: 4 - protein, 8 aa, Artificial Sequence
  Description of Artificial Sequence: peptide linker
GGRRGGGS

SEQ ID NO: 5 - protein, 9 aa, Artificial Sequence
  Description of Artificial Sequence: peptide linker
LRQRDGERP

SEQ ID NO: 6 - protein, 12 aa, Artificial Sequence
  Description of Artificial Sequence: peptide linker
LRQKDGGGSERP

SEQ ID NO: 7 - protein, 16 aa, Artificial Sequence
  Description of Artificial Sequence: peptide linker
LRQKDGGGSGGGSERP

SEQ ID NO: 8 - protein, 25 aa, Artificial Sequence
  Description of Artificial Sequence: exemplary motif
  MOD_RES (2)..(5): this region may encompass two to four residues consisting of any amino acid
  MOD_RES (7)..(18): any amino acid
  MOD_RES (20)..(24): this region may encompass three to five residues consisting of any amino acid
CXXXXCXXXXXXXXXXXXHXXXXXH

SEQ ID NO: 9 - protein, 30 aa, Artificial Sequence
  Description of Artificial Sequence: mouse transcription factor Zif268
YACPVESCDRRFSRSDELTRHIRIHTGQKP

SEQ ID NO: 10 - protein, 28 aa, Artificial Sequence
  Description of Artificial Sequence: mouse transcription factor Zif268
FQCRICMRNFSRSDHLTTHIRTHTGEKP

SEQ ID NO: 11 - protein, 27 aa, Artificial Sequence
  Description of Artificial Sequence: mouse transcription factor Zif268
FACDICGRKFARSDERKRHTKIHLRQK

SEQ ID NO: 12 - DNA, 9 bp, Artificial Sequence
  Description of Artificial Sequence: target DNA
gcgtgggcg

SEQ ID NO: 13 - protein, 94 aa, Artificial Sequence
  Description of Artificial Sequence: Sp-1 transcription factor
PGKKKQHICHIQGCGKVYGKTSHLRAHLRWHTGERPFMCTWSYCGKRFTRSDELQRHKRTHTGEKKFACPECPKRFMRSDHLSKHIKTHQNKKG

SEQ ID NO: 14 - DNA, 9 bp, Artificial Sequence
  Description of Artificial Sequence: target DNA
ggggcgggg

SEQ ID NO: 15 - protein, 100 aa, Artificial Sequence
  Description of Artificial Sequence: Sp-1 consensus sequence
MEKLRNGSGDPGKKKQHACPECGKSFSKSSHLRAHQRTHTGERPYKCPECGKSFSRSDELQRHQRTHTGEKPYKCPECGKSFSRSDHLSKHQRTHQNKKG

SEQ ID NO: 16 - DNA, 9 bp, Artificial Sequence
  Description of Artificial Sequence: Sp-1 consensus sequence
ggggcgggg

SEQ ID NO: 17 - DNA, 9 bp, Artificial Sequence
  Description of Artificial Sequence: example target DNA
gcgggggcg

SEQ ID NO: 18 - DNA, 9 bp, Artificial Sequence
  Description of Artificial Sequence: example target DNA
gcgggggcg

SEQ ID NO: 19 - DNA, 9 bp, Artificial Sequence
  Description of Artificial Sequence: example target DNA
gcggaggcg

SEQ ID NO: 20 - DNA, 9 bp, Artificial Sequence
  Description of Artificial Sequence: example target DNA
gcggccgcg

SEQ ID NO: 21 - DNA, 9 bp, Artificial Sequence
  Description of Artificial Sequence: example target DNA
ggatggggg

SEQ ID NO: 22 - DNA, 9 bp, Artificial Sequence
  Description of Artificial Sequence: example target DNA
gcggggtcc

SEQ ID NO: 23 - DNA, 9 bp, Artificial Sequence
  Description of Artificial Sequence: example target DNA
gcgggcggg

SEQ ID NO: 24 - DNA, 9 bp, Artificial Sequence
  Description of Artificial Sequence: example target DNA
gcagaggag

SEQ ID NO: 25 - DNA, 9 bp, Artificial Sequence
  Description of Artificial Sequence: example target DNA
gaggtggcc

SEQ ID NO: 26 - DNA, 9 bp, Artificial Sequence
  Description of Artificial Sequence: example target DNA
gcgggggct

SEQ ID NO: 27 - DNA, 9 bp, Artificial Sequence
  Description of Artificial Sequence: example target DNA
gcgggggct

SEQ ID NO: 28 - DNA, 9 bp, Artificial Sequence
  Description of Artificial Sequence: example target DNA
gtggctgcc

SEQ ID NO: 29 - DNA, 9 bp, Artificial Sequence
  Description of Artificial Sequence: example target DNA
gtggctgcc

SEQ ID NO: 30 - DNA, 9 bp, Artificial Sequence
  Description of Artificial Sequence: example target DNA
ggggccggg

SEQ ID NO: 31 - DNA, 9 bp, Artificial Sequence
  Description of Artificial Sequence: example target DNA
ggggccggg

SEQ ID NO: 32 - DNA, 9 bp, Artificial Sequence
  Description of Artificial Sequence: example target DNA
gcaggggcc

SEQ ID NO: 33 - DNA, 10 bp, Artificial Sequence
  Description of Artificial Sequence: example target DNA
tgcggggcaa

SEQ ID NO: 34 - DNA, 10 bp, Artificial Sequence
  Description of Artificial Sequence: example target DNA
tgcggggcaa

SEQ ID NO: 35 - DNA, 10 bp, Artificial Sequence
  Description of Artificial Sequence: example target DNA
tgcggggcaa

SEQ ID NO: 36 - DNA, 10 bp, Artificial Sequence
  Description of Artificial Sequence: example target DNA
tgcggggcaa

SEQ ID NO: 37 - DNA, 10 bp, Artificial Sequence
  Description of Artificial Sequence: example target DNA
tgcggggcaa

SEQ ID NO: 38 - DNA, 10 bp, Artificial Sequence
  Description of Artificial Sequence: example target DNA
tgcggggcaa

SEQ ID NO: 39 - DNA, 10 bp, Artificial Sequence
  Description of Artificial Sequence: example target DNA
tgcggggcaa

SEQ ID NO: 40 - DNA, 10 bp, Artificial Sequence
  Description of Artificial Sequence: example target DNA
tgcggggcaa

SEQ ID NO: 41 - DNA, 10 bp, Artificial Sequence
  Description of Artificial Sequence: example target DNA
tgcggggcaa

SEQ ID NO: 42 - DNA, 10 bp, Artificial Sequence
  Description of Artificial Sequence: example target DNA
tgcggggcaa

SEQ ID NO: 43 - DNA, 10 bp, Artificial Sequence
  Description of Artificial Sequence: example target DNA
tgcggggcaa

SEQ ID NO: 44 - DNA, 10 bp, Artificial Sequence
  Description of Artificial Sequence: example target DNA
tgcggggcaa

SEQ ID NO: 45 - DNA, 9 bp, Artificial Sequence
  Description of Artificial Sequence: example target DNA
gggggcggg

SEQ ID NO: 46 - DNA, 9 bp, Artificial Sequence
  Description of Artificial Sequence: example target DNA
gagggggcg

SEQ ID NO: 47 - DNA, 9 bp, Artificial Sequence
  Description of Artificial Sequence: example target DNA
gtagttgtg

SEQ ID NO: 48 - DNA, 9 bp, Artificial Sequence
  Description of Artificial Sequence: example target DNA
gtagttgtg

SEQ ID NO: 49 - DNA, 9 bp, Artificial Sequence
  Description of Artificial Sequence: example target DNA
gtagttgtg

SEQ ID NO: 50 - DNA, 9 bp, Artificial Sequence
  Description of Artificial Sequence: example target DNA
gtagttgtg

SEQ ID NO: 51 - DNA, 9 bp, Artificial Sequence
  Description of Artificial Sequence: example target DNA
gtagttgtg

SEQ ID NO: 52 - DNA, 9 bp, Artificial Sequence
  Description of Artificial Sequence: example target DNA
gctgaggaa

SEQ ID NO: 53 - DNA, 9 bp, Artificial Sequence
  Description of Artificial Sequence: example target DNA
gaggaagat

SEQ ID NO: 54 - DNA, 9 bp, Artificial Sequence
  Description of Artificial Sequence: example target DNA
gtagttgtg

SEQ ID NO: 55 - DNA, 9 bp, Artificial Sequence
  Description of Artificial Sequence: example target DNA
gtagttgtg

SEQ ID NO: 56 - DNA, 9 bp, Artificial Sequence
  Description of Artificial Sequence: example target DNA
gtagttgtg

SEQ ID NO: 57 - DNA, 9 bp, Artificial Sequence
  Description of Artificial Sequence: example target DNA
gtagttgtg

SEQ ID NO: 58 - DNA, 9 bp, Artificial Sequence
  Description of Artificial Sequence: example target DNA
gtagttgtg

SEQ ID NO: 59 - DNA, 9 bp, Artificial Sequence
  Description of Artificial Sequence: example target DNA
gatgctgag

SEQ ID NO: 60 - DNA, 9 bp, Artificial Sequence
  Description of Artificial Sequence: example target DNA
gatgctgag

SEQ ID NO: 61 - DNA, 9 bp, Artificial Sequence
  Description of Artificial Sequence: example target DNA
gatgctgag

SEQ ID NO: 62 - DNA, 9 bp, Artificial Sequence
  Description of Artificial Sequence: example target DNA
gctgaggaa

SEQ ID NO: 63 - DNA, 9 bp, Artificial Sequence
  Description of Artificial Sequence: example target DNA
gaagatgac

SEQ ID NO: 64 - DNA, 9 bp, Artificial Sequence
  Description of Artificial Sequence: example target DNA
gaagatgac

SEQ ID NO: 65 - DNA, 9 bp, Artificial Sequence
  Description of Artificial Sequence: example target DNA
gatgacgac

SEQ ID NO: 66 - DNA, 9 bp, Artificial Sequence
  Description of Artificial Sequence: example target DNA
gacgacggc

SEQ ID NO: 67 - DNA, 9 bp, Artificial Sequence
  Description of Artificial Sequence: example target DNA
gacgacggc

SEQ ID NO: 68 - DNA, 9 bp, Artificial Sequence
  Description of Artificial Sequence: example target DNA
gacgacggc

SEQ ID NO: 69 - DNA, 9 bp, Artificial Sequence
  Description of Artificial Sequence: example target DNA
gacggcgta

SEQ ID NO: 70 - DNA, 9 bp, Artificial Sequence
  Description of Artificial Sequence: example target DNA
gacggcgta

SEQ ID NO: 71 - DNA, 9 bp, Artificial Sequence
  Description of Artificial Sequence: example target DNA
gacggcgta

SEQ ID NO: 72 - DNA, 9 bp, Artificial Sequence
  Description of Artificial Sequence: example target DNA
gacggcgta

SEQ ID NO: 73 - DNA, 9 bp, Artificial Sequence
  Description of Artificial Sequence: example target DNA
gagggggcg

SEQ ID NO: 74 - DNA, 10 bp, Artificial Sequence
  Description of Artificial Sequence: example target DNA
gccgaggtgc

SEQ ID NO: 75 - DNA, 10 bp, Artificial Sequence
  Description of Artificial Sequence: example target DNA
ggtggagtca

SEQ ID NO: 76 - DNA, 10 bp, Artificial Sequence
  Description of Artificial Sequence: example target DNA
gtcgcagtga

SEQ ID NO: 77 - DNA, 10 bp, Artificial Sequence
  Description of Artificial Sequence: example target DNA
gacttggtgc

SEQ ID NO: 78 - DNA, 10 bp, Artificial Sequence
  Description of Artificial Sequence: example target DNA
ggtggagtca

SEQ ID NO: 79 - DNA, 10 bp, Artificial Sequence
  Description of Artificial Sequence: example target DNA
gagtactgta

SEQ ID NO: 80 - DNA, 10 bp, Artificial Sequence
  Description of Artificial Sequence: example target DNA
gtggaggaga

SEQ ID NO: 81 - DNA, 10 bp, Artificial Sequence
  Description of Artificial Sequence: example target DNA
gtggaggaga

SEQ ID NO: 82 - DNA, 10 bp, Artificial Sequence
  Description of Artificial Sequence: example target DNA
caggctgcgc

SEQ ID NO: 83 - DNA, 10 bp, Artificial Sequence
  Description of Artificial Sequence: example target DNA
caggctgcgc

SEQ ID NO: 84 - DNA, 10 bp, Artificial Sequence
  Description of Artificial Sequence: example target DNA
caggctgcgc

SEQ ID NO: 85 - DNA, 10 bp, Artificial Sequence
  Description of Artificial Sequence: example target DNA
gaagaggtct

SEQ ID NO: 86 - DNA, 10 bp, Artificial Sequence
  Description of Artificial Sequence: example target DNA
gaggtctgga

SEQ ID NO: 87 - DNA, 10 bp, Artificial Sequence
  Description of Artificial Sequence: example target DNA
ggagaggatg

SEQ ID NO: 88 - DNA, 10 bp, Artificial Sequence
  Description of Artificial Sequence: example target DNA
ggagaggatg

SEQ ID NO: 89 - DNA, 10 bp, Artificial Sequence
  Description of Artificial Sequence: example target DNA
ggagaggatg

SEQ ID NO: 90 - DNA, 10 bp, Artificial Sequence
  Description of Artificial Sequence: example target DNA
gtggcggacc

SEQ ID NO: 91 - DNA, 10 bp, Artificial Sequence
  Description of Artificial Sequence: example target DNA
gtggcggacc

SEQ ID NO: 92 - DNA, 10 bp, Artificial Sequence
  Description of Artificial Sequence: example target DNA
gagggcgaag

SEQ ID NO: 93 - DNA, 10 bp, Artificial Sequence
  Description of Artificial Sequence: example target DNA
gagggcgaag

SEQ ID NO: 94 - DNA, 10 bp, Artificial Sequence
  Description of Artificial Sequence: example target DNA
ggagaggttt

SEQ ID NO: 95 - DNA, 10 bp, Artificial Sequence
  Description of Artificial Sequence: example target DNA
ggagaggttt

SEQ ID NO: 96 - DNA, 10 bp, Artificial Sequence
  Description of Artificial Sequence: example target DNA
tggtaggggg

SEQ ID NO: 97 - DNA, 10 bp, Artificial Sequence
  Description of Artificial Sequence: example target DNA
tagggggtgg

SEQ ID NO: 98 - DNA, 10 bp, Artificial Sequence
  Description of Artificial Sequence: example target DNA
gccgaggtgc

SEQ ID NO: 99 - DNA, 10 bp, Artificial Sequence
  Description of Artificial Sequence: example target DNA
gccgaggtgc

SEQ ID NO: 100 - DNA, 10 bp, Artificial Sequence
  Description of Artificial Sequence: example target DNA
gccgaggtgc

SEQ ID NO: 101 - DNA, 10 bp, Artificial Sequence
  Description of Artificial Sequence: example target DNA
gcgggcgggc

SEQ ID NO: 102 - DNA, 10 bp, Artificial Sequence
  Description of Artificial Sequence: example target DNA
gagtgtgtga

SEQ ID NO: 103 - DNA, 10 bp, Artificial Sequence
  Description of Artificial Sequence: example target DNA
gagtgtgtga

SEQ ID NO: 104 - DNA, 10 bp, Artificial Sequence
  Description of Artificial Sequence: example target DNA
gagtgtgtga

SEQ ID NO: 105 - DNA, 10 bp, Artificial Sequence
  Description of Artificial Sequence: example target DNA
gagtgtgtga

SEQ ID NO: 106 - DNA, 10 bp, Artificial Sequence
  Description of Artificial Sequence: example target DNA
gagtgtgtga

SEQ ID NO: 107 - DNA, 10 bp, Artificial Sequence
  Description of Artificial Sequence: example target DNA
gagtgtgtga

SEQ ID NO: 108 - DNA, 10 bp, Artificial Sequence
  Description of Artificial Sequence: example target DNA
gagtgtgtga

SEQ ID NO: 109 - DNA, 10 bp, Artificial Sequence
  Description of Artificial Sequence: example target DNA
gagtgtgtga

SEQ ID NO: 110 - DNA, 10 bp, Artificial Sequence
  Description of Artificial Sequence: example target DNA
gagtgtgtga

SEQ ID NO: 111 - DNA, 10 bp, Artificial Sequence
  Description of Artificial Sequence: example target DNA
gagtgtgtga

SEQ ID NO: 112 - DNA, 10 bp, Artificial Sequence
  Description of Artificial Sequence: example target DNA
gagtgtgtga

SEQ ID NO: 113 - DNA, 10 bp, Artificial Sequence
  Description of Artificial Sequence: example target DNA
gagtgtgtga

SEQ ID NO: 114 - DNA, 9 bp, Artificial Sequence
  Description of Artificial Sequence: example target DNA
tgcggggca

SEQ ID NO: 115 - DNA, 10 bp, Artificial Sequence
  Description of Artificial Sequence: example target DNA
gagtgtgtga

SEQ ID NO: 116 - DNA, 10 bp, Artificial Sequence
  Description of Artificial Sequence: example target DNA
gagtgtgtga

SEQ ID NO: 117 - DNA, 10 bp, Artificial Sequence
  Description of Artificial Sequence: example target DNA
gagtgtgtga

SEQ ID NO: 118 - DNA, 10 bp, Artificial Sequence
  Description of Artificial Sequence: example target DNA
gagtgtgtga

SEQ ID NO: 119 - DNA, 9 bp, Artificial Sequence
  Description of Artificial Sequence: example target DNA
gatgctgag

SEQ ID NO: 120 - DNA, 9 bp, Artificial Sequence
  Description of Artificial Sequence: example target DNA
gaagatgac

SEQ ID NO: 121 - DNA, 9 bp, Artificial Sequence
  Description of Artificial Sequence: example target DNA
gatgacgac

SEQ ID NO: 122 - DNA, 9 bp, Artificial Sequence
  Description of Artificial Sequence: example target DNA
gtagttgtg

SEQ ID NO: 123 - protein, 7 aa, Artificial Sequence
  Description of Artificial Sequence: example ZFP
RSDELTR

SEQ ID NO: 124 - protein, 7 aa, Artificial Sequence
  Description of Artificial Sequence: example ZFP
RSDELTR

SEQ ID NO: 125 - protein, 7 aa, Artificial Sequence
  Description of Artificial Sequence: example ZFP
RSDELTR

SEQ ID NO: 126 - protein, 7 aa, Artificial Sequence
  Description of Artificial Sequence: example ZFP
RSDELTR

SEQ ID NO: 127 - protein, 7 aa, Artificial Sequence
  Description of Artificial Sequence: example ZFP
RSDHLAR

SEQ ID NO: 128 - protein, 7 aa, Artificial Sequence
  Description of Artificial Sequence: example ZFP
ERGDLTT

SEQ ID NO: 129 - protein, 7 aa, Artificial Sequence
  Description of Artificial Sequence: example ZFP
RSDHLTR

SEQ ID NO: 130 - protein, 7 aa, Artificial Sequence
  Description of Artificial Sequence: example ZFP
RSDNLAR

SEQ ID NO: 131 - protein, 7 aa, Artificial Sequence
  Description of Artificial Sequence: example ZFP
ERGTLAR

SEQ ID NO: 132 - protein, 7 aa, Artificial Sequence
  Description of Artificial Sequence: example ZFP
QSSDLQR

SEQ ID NO: 133 - protein, 7 aa, Artificial Sequence
  Description of Artificial Sequence: example ZFP
QSSDLQR

SEQ ID NO: 134 - protein, 7 aa, Artificial Sequence
  Description of Artificial Sequence: example ZFP
DRSSLTR

SEQ ID NO: 135 - protein, 7 aa, Artificial Sequence
  Description of Artificial Sequence: example ZFP
ERGTLAR

SEQ ID NO: 136 - protein, 7 aa, Artificial Sequence
  Description of Artificial Sequence: example ZFP
RSDHLTR

SEQ ID NO: 137 - protein, 7 aa, Artificial Sequence
  Description of Artificial Sequence: example ZFP
RSDHLTR

SEQ ID NO: 138 - protein, 7 aa, Artificial Sequence
  Description of Artificial Sequence: example ZFP
DRSSLTR

SEQ ID NO: 139 - protein, 7 aa, Artificial Sequence
  Description of Artificial Sequence: example ZFP
RSADLTR

SEQ ID NO: 140 - protein, 7 aa, Artificial Sequence
  Description of Artificial Sequence: example ZFP
RSADLTR

SEQ ID NO: 141 - protein, 7 aa, Artificial Sequence
  Description of Artificial Sequence: example ZFP
RSADLTR

SEQ ID NO: 142 - protein, 7 aa, Artificial Sequence
  Description of Artificial Sequence: example ZFP
RSADLTR

SEQ ID NO: 143 - protein, 7 aa, Artificial Sequence
  Description of Artificial Sequence: example ZFP
RSADLTR

SEQ ID NO: 144 - protein, 7 aa, Artificial Sequence
  Description of Artificial Sequence: example ZFP
RSADLTR

SEQ ID NO: 145 - protein, 7 aa, Artificial Sequence
  Description of Artificial Sequence: example ZFP
QSGSLTR

SEQ ID NO: 146 - protein, 7 aa, Artificial Sequence
  Description of Artificial Sequence: example ZFP
QSGSLTR

SEQ ID NO: 147 - protein, 7 aa, Artificial Sequence
  Description of Artificial Sequence: example ZFP
QSGSLTR

SEQ ID NO: 148 - protein, 7 aa, Artificial Sequence
  Description of Artificial Sequence: example ZFP
QSGSLTR

SEQ ID NO: 149 - protein, 7 aa, Artificial Sequence
  Description of Artificial Sequence: example ZFP
QSGSLTR

SEQ ID NO: 150 - protein, 7 aa, Artificial Sequence
  Description of Artificial Sequence: example ZFP
QSGSLTR

SEQ ID NO: 151 - protein, 7 aa, Artificial Sequence
  Description of Artificial Sequence: example ZFP
RSDHLTR

SEQ ID NO: 152 - protein, 7 aa, Artificial Sequence
  Description of Artificial Sequence: example ZFP
RSDELTR

SEQ ID NO: 153 - protein, 7 aa, Artificial Sequence
  Description of Artificial Sequence: example ZFP
RSDALTR

SEQ ID NO: 154 - protein, 7 aa, Artificial Sequence
  Description of Artificial Sequence: example ZFP
RSDALTR

SEQ ID NO: 155 - protein, 7 aa, Artificial Sequence
  Description of Artificial Sequence: example ZFP
RSDALTR

SEQ ID NO: 156 - protein, 7 aa, Artificial Sequence
  Description of Artificial Sequence: example ZFP
RSDSLLR

SEQ ID NO: 157 - protein, 7 aa, Artificial Sequence
  Description of Artificial Sequence: example ZFP
RSDSLLR

SEQ ID NO: 158 - protein, 7 aa, Artificial Sequence
  Description of Artificial Sequence: example ZFP
QRSNLVR

SEQ ID NO: 159 - protein, 7 aa, Artificial Sequence
  Description of Artificial Sequence: example ZFP
QQSNLAR

SEQ ID NO: 160 - protein, 7 aa, Artificial Sequence
  Description of Artificial Sequence: example ZFP
RSDALTR

SEQ ID NO: 161 - protein, 7 aa, Artificial Sequence
  Description of Artificial Sequence: example ZFP
RSDSLLR

SEQ ID NO: 162 - protein, 7 aa, Artificial Sequence
  Description of Artificial Sequence: example ZFP
DSDSLLR

SEQ ID NO: 163 - protein, 7 aa, Artificial Sequence
  Description of Artificial Sequence: example ZFP
RSDSLLR

SEQ ID NO: 164 - protein, 7 aa, Artificial Sequence
  Description of Artificial Sequence: example ZFP
RSDALTR

SEQ ID NO: 165 - protein, 7 aa, Artificial Sequence
  Description of Artificial Sequence: example ZFP
RSDNLTR

SEQ ID NO: 166 - protein, 7 aa, Artificial Sequence
  Description of Artificial Sequence: example ZFP
RSDNLTR

SEQ ID NO: 167 - protein, 7 aa, Artificial Sequence
  Description of Artificial Sequence: example ZFP
RSDNLTR

SEQ ID NO: 168 - protein, 7 aa, Artificial Sequence
  Description of Artificial Sequence: example ZFP
QRSNLVR

SEQ ID NO: 169 - protein, 7 aa, Artificial Sequence
  Description of Artificial Sequence: example ZFP
DSSNLTR

SEQ ID NO: 170 - protein, 7 aa, Artificial Sequence
  Description of Artificial Sequence: example ZFP
DSSNLTR

SEQ ID NO: 171 - protein, 7 aa, Artificial Sequence
  Description of Artificial Sequence: example ZFP
EKANLTR

SEQ ID NO: 172 - protein, 7 aa, Artificial Sequence
  Description of Artificial Sequence: example ZFP
DSGHLTR

SEQ ID NO: 173 - protein, 7 aa, Artificial Sequence
  Description of Artificial Sequence: example ZFP
DSGHLTR

SEQ ID NO: 174 - protein, 7 aa, Artificial Sequence
  Description of Artificial Sequence: example ZFP
DSGNLTR

SEQ ID NO: 175 - protein, 7 aa, Artificial Sequence
  Description of Artificial Sequence: example ZFP
QSASLTR

SEQ ID NO: 176 - protein, 7 aa, Artificial Sequence
  Description of Artificial Sequence: example ZFP
QSASLTR

SEQ ID NO: 177 - protein, 7 aa, Artificial Sequence
  Description of Artificial Sequence: example ZFP
QRSALAR

SEQ ID NO: 178 - protein, 7 aa, Artificial Sequence
  Description of Artificial Sequence: example ZFP
QRSALAR

SEQ ID NO: 179 - protein, 7 aa, Artificial Sequence
  Description of Artificial Sequence: example ZFP
RSDELTR

SEQ ID NO: 180 - protein, 7 aa, Artificial Sequence
  Description of Artificial Sequence: example ZFP
RSDSLLR

SEQ ID NO: 181 - protein, 7 aa, Artificial Sequence
  Description of Artificial Sequence: example ZFP
DSGSLTR

SEQ ID NO: 182 - protein, 7 aa, Artificial Sequence
  Description of Artificial Sequence: example ZFP
RSDSLRR

SEQ ID NO: 183 - protein, 7 aa, Artificial Sequence
  Description of Artificial Sequence: example ZFP
RSDTLAR

SEQ ID NO: 184 - protein, 7 aa, Artificial Sequence
  Description of Artificial Sequence: example ZFP
DRSALAR

SEQ ID NO: 185 - protein, 7 aa, Artificial Sequence
  Description of Artificial Sequence: example ZFP
QRSHLTT

SEQ ID NO: 186 - protein, 7 aa, Artificial Sequence
  Description of Artificial Sequence: example ZFP
RSDNLTR

SEQ ID NO: 187 - protein, 7 aa, Artificial Sequence
  Description of Artificial Sequence: example ZFP
RSDNLTR

SEQ ID NO: 188 - protein, 7 aa, Artificial Sequence
  Description of Artificial Sequence: example ZFP
RSDDLTR

SEQ ID NO: 189 - protein, 7 aa, Artificial Sequence
  Description of Artificial Sequence: example ZFP
RSDELTR

SEQ ID NO: 190 - protein, 7 aa, Artificial Sequence
  Description of Artificial Sequence: example ZFP
RSDDLTR

SEQ ID NO: 191 - protein, 7 aa, Artificial Sequence
  Description of Artificial Sequence: example ZFP
DRSALAR

SEQ ID NO: 192 - protein, 7 aa, Artificial Sequence
  Description of Artificial Sequence: example ZFP
RSSHLTT

SEQ ID NO: 193 - protein, 7 aa, Artificial Sequence
  Description of Artificial Sequence: example ZFP
TTSNLRR

SEQ ID NO: 194 - protein, 7 aa, Artificial Sequence
  Description of Artificial Sequence: example ZFP
TTSNLRR

SEQ ID NO: 195 - protein, 7 aa, Artificial Sequence
  Description of Artificial Sequence: example ZFP
TTSNLRR

SEQ ID NO: 196 - protein, 7 aa, Artificial Sequence
  Description of Artificial Sequence: example ZFP
DSSNLTR

SEQ ID NO: 197 - protein, 7 aa, Artificial Sequence
  Description of Artificial Sequence: example ZFP
DSSNLTR

SEQ ID NO: 198 - protein, 7 aa, Artificial Sequence
  Description of Artificial Sequence: example ZFP
QSANLAR

SEQ ID NO: 199 - protein, 7 aa, Artificial Sequence
  Description of Artificial Sequence: example ZFP
QSDNLAR

SEQ ID NO: 200 - protein, 7 aa, Artificial Sequence
  Description of Artificial Sequence: example ZFP
QSSALAR

SEQ ID NO: 201 - protein, 7 aa, Artificial Sequence
  Description of Artificial Sequence: example ZFP
NRATLAR

SEQ ID NO: 202 - protein, 7 aa, Artificial Sequence
  Description of Artificial Sequence: example ZFP
RSDHLAR

SEQ ID NO: 203 - protein, 7 aa, Artificial Sequence
  Description of Artificial Sequence: example ZFP
RSDSLLR

SEQ ID NO: 204 - protein, 7 aa, Artificial Sequence
  Description of Artificial Sequence: example ZFP
RSDSLLR

SEQ ID NO: 205 - protein, 7 aa, Artificial Sequence
  Description of Artificial Sequence: example ZFP
RSDSLLR

SEQ ID NO: 206 - protein, 7 aa, Artificial Sequence
  Description of Artificial Sequence: example ZFP
RSDSLLR

SEQ ID NO: 207 - protein, 7 aa, Artificial Sequence
  Description of Artificial Sequence: example ZFP
RSDHLTR

SEQ ID NO: 208 - protein, 7 aa, Artificial Sequence
  Description of Artificial Sequence: example ZFP
RSDLLQR

SEQ ID NO: 209 - protein, 7 aa, Artificial Sequence
  Description of Artificial Sequence: example ZFP
RSDSLLR

SEQ ID NO: 210 - protein, 7 aa, Artificial Sequence
  Description of Artificial Sequence: example ZFP
RKDSLVR

SEQ ID NO: 211 - protein, 7 aa, Artificial Sequence
  Description of Artificial Sequence: example ZFP
RSDLLQR

SEQ ID NO: 212 - protein, 7 aa, Artificial Sequence
  Description of Artificial Sequence: example ZFP
RKDSLVR

SEQ ID NO: 213 - protein, 7 aa, Artificial Sequence
  Description of Artificial Sequence: example ZFP
RSSLLQR

SEQ ID NO: 214 - protein, 7 aa, Artificial Sequence
  Description of Artificial Sequence: example ZFP
RSSLLQR

SEQ ID NO: 215 - protein, 7 aa, Artificial Sequence
  Description of Artificial Sequence: example ZFP
RKDSLVR

SEQ ID NO: 216 - protein, 7 aa, Artificial Sequence
  Description of Artificial Sequence: example ZFP
RSDLLQR

SEQ ID NO: 217 - protein, 7 aa, Artificial Sequence
  Description of Artificial Sequence: example ZFP
RKDSLVR

SEQ ID NO: 218 - protein, 7 aa, Artificial Sequence
  Description of Artificial Sequence: example ZFP
RSDSLLR

SEQ ID NO: 219 - protein, 7 aa, Artificial Sequence
  Description of Artificial Sequence: example ZFP
RKDSLVR

SEQ ID NO: 220 - protein, 7 aa, Artificial Sequence
  Description of Artificial Sequence: example ZFP
QSGDLTR

SEQ ID NO: 221 - protein, 7 aa, Artificial Sequence
  Description of Artificial Sequence: example ZFP
RSDSLLR

SEQ ID NO: 222 - protein, 7 aa, Artificial Sequence
  Description of Artificial Sequence: example ZFP
RSSLLQR

SEQ ID NO: 223 - protein, 7 aa, Artificial Sequence
  Description of Artificial Sequence: example ZFP
RKDSLVR

SEQ ID NO: 224 - protein, 7 aa, Artificial Sequence
  Description of Artificial Sequence: example ZFP
RSDSLLR

SEQ ID NO: 225 - protein, 7 aa, Artificial Sequence
  Description of Artificial Sequence: example ZFP
RSDNLTR

SEQ ID NO: 226 - protein, 7 aa, Artificial Sequence
  Description of Artificial Sequence: example ZFP
EKANLTR

SEQ ID NO: 227 - protein, 7 aa, Artificial Sequence
  Description of Artificial Sequence: example ZFP
EKANLTR

SEQ ID NO: 228 - protein, 7 aa, Artificial Sequence
  Description of Artificial Sequence: example ZFP
RSDSLLR

SEQ ID NO: 229 - protein, 7 aa, Artificial Sequence
  Description of Artificial Sequence: example ZFP
RSDHLSR

SEQ ID NO: 230 - protein, 7 aa, Artificial Sequence
  Description of Artificial Sequence: example ZFP
RSDHLSR

SEQ ID NO: 231 - protein, 7 aa, Artificial Sequence
  Description of Artificial Sequence: example ZFP
RSDNLTR

SEQ ID NO: 232 - protein, 7 aa, Artificial Sequence
  Description of Artificial Sequence: example ZFP
DRSSLTR

SEQ ID NO: 233 - protein, 7 aa, Artificial Sequence
  Description of Artificial Sequence: example ZFP
RSDHLTT

SEQ ID NO: 234 - protein, 7 aa, Artificial Sequence
  Description of Artificial Sequence: example ZFP
RSDHLSR

SEQ ID NO: 235 - protein, 7 aa, Artificial Sequence
  Description of Artificial Sequence: example ZFP
ERGHLTR

SEQ ID NO: 236 - protein, 7 aa, Artificial Sequence
  Description of Artificial Sequence: example ZFP
RSDNLAR

SEQ ID NO: 237 - protein, 7 aa, Artificial Sequence
  Description of Artificial Sequence: example ZFP
RSDALSR

SEQ ID NO: 238 - protein, 7 aa, Artificial Sequence
  Description of Artificial Sequence: example ZFP
RSDHLSR

SEQ ID NO: 239 - protein, 7 aa, Artificial Sequence
  Description of Artificial Sequence: example ZFP
RSDHLSR

SEQ ID NO: 240 - protein, 7 aa, Artificial Sequence
  Description of Artificial Sequence: example ZFP
QSSDLQR

SEQ ID NO: 241 - protein, 7 aa, Artificial Sequence
  Description of Artificial Sequence: example ZFP
QSSDLQR

SEQ ID NO: 242 - protein, 7 aa, Artificial Sequence
  Description of Artificial Sequence: example ZFP
DRSSLTR

SEQ ID NO: 243 - protein, 7 aa, Artificial Sequence
  Description of Artificial Sequence: example ZFP
ERGTLAR

SEQ ID NO: 244 - protein, 7 aa, Artificial Sequence
  Description of Artificial Sequence: example ZFP
RSDHLSR

SEQ ID NO: 245 - protein, 7 aa, Artificial Sequence
  Description of Artificial Sequence: example ZFP
RSDHLTR

SEQ ID NO: 246 - protein, 7 aa, Artificial Sequence
  Description of Artificial Sequence: example ZFP
RSDHLTR

SEQ ID NO: 247 - protein, 7 aa, Artificial Sequence
  Description of Artificial Sequence: example ZFP
RSDHLTT

SEQ ID NO: 248 - protein, 7 aa, Artificial Sequence
  Description of Artificial Sequence: example ZFP
RSDHLTT

SEQ ID NO: 249 - protein, 7 aa, Artificial Sequence
  Description of Artificial Sequence: example ZFP
RGDHLKD

SEQ ID NO: 250 - protein, 7 aa, Artificial Sequence
  Description of Artificial Sequence: example ZFP
RGDHLKD

SEQ ID NO: 251 - protein, 7 aa, Artificial Sequence
  Description of Artificial Sequence: example ZFP
RSDHLTR

SEQ ID NO: 252 - protein, 7 aa, Artificial Sequence
  Description of Artificial Sequence: example ZFP
RSDHLTR

SEQ ID NO: 253 - protein, 7 aa, Artificial Sequence
  Description of Artificial Sequence: example ZFP
RSDHLTT

SEQ ID NO: 254 - protein, 7 aa, Artificial Sequence
  Description of Artificial Sequence: example ZFP
RSDHLTT

SEQ ID NO: 255 - protein, 7 aa, Artificial Sequence
  Description of Artificial Sequence: example ZFP
RGDHLKD

SEQ ID NO: 256 - protein, 7 aa, Artificial Sequence
  Description of Artificial Sequence: example ZFP
RGDHLKD

SEQ ID NO: 257 - protein, 7 aa, Artificial Sequence
  Description of Artificial Sequence: example ZFP
DSGHLTR

SEQ ID NO: 258 - protein, 7 aa, Artificial Sequence
  Description of Artificial Sequence: example ZFP
RSDHLTR

SEQ ID NO: 259 - protein, 7 aa, Artificial Sequence
  Description of Artificial Sequence: example ZFP
TGGSLAR

SEQ ID NO: 260 - protein, 7 aa, Artificial Sequence
  Description of Artificial Sequence: example ZFP
NRATLAR

SEQ ID NO: 261 - protein, 7 aa, Artificial Sequence
  Description of Artificial Sequence: example ZFP
NRATLAR

SEQ ID NO: 262 - protein, 7 aa, Artificial Sequence
  Description of Artificial Sequence: example ZFP
TGGSLAR

SEQ ID NO: 263 - protein, 7 aa, Artificial Sequence
  Description of Artificial Sequence: example ZFP
NRATLAR

SEQ ID NO: 264 - protein, 7 aa, Artificial Sequence
  Description of Artificial Sequence: example ZFP
RSDNLTR

SEQ ID NO: 265 - protein, 7 aa, Artificial Sequence
  Description of Artificial Sequence: example ZFP
QSGNLQR

SEQ ID NO: 266 - protein, 7 aa, Artificial Sequence
  Description of Artificial Sequence: example ZFP
TGGSLAR

SEQ ID NO: 267 - protein, 7 aa, Artificial Sequence
  Description of Artificial Sequence: example ZFP
NRATLAR

SEQ ID NO: 268 - protein, 7 aa, Artificial Sequence
  Description of Artificial Sequence: example ZFP
TGGSLAR

SEQ ID NO: 269 - protein, 7 aa, Artificial Sequence
  Description of Artificial Sequence: example ZFP
TGGSLTR

SEQ ID NO: 270 - protein, 7 aa, Artificial Sequence
  Description of Artificial Sequence: example ZFP
TGGSLAR

SEQ ID NO: 271 - protein, 7 aa, Artificial Sequence
  Description of Artificial Sequence: example ZFP
TSSELQR

SEQ ID NO: 272 - protein, 7 aa, Artificial Sequence
  Description of Artificial Sequence: example ZFP
QSSDLQR

SEQ ID NO: 273 - protein, 7 aa, Artificial Sequence
  Description of Artificial Sequence: example ZFP
QSSDLQR

SEQ ID NO: 274 - protein, 7 aa, Artificial Sequence
  Description of Artificial Sequence: example ZFP
RSDNLTR

SEQ ID NO: 275 - protein, 7 aa, Artificial Sequence
  Description of Artificial Sequence: example ZFP
QQSNLAR

SEQ ID NO: 276 - protein, 7 aa, Artificial Sequence
  Description of Artificial Sequence: example ZFP
TSANLSR

SEQ ID NO: 277 - protein, 7 aa, Artificial Sequence
  Description of Artificial Sequence: example ZFP
DSSNLTR

SEQ ID NO: 278 - protein, 7 aa, Artificial Sequence
  Description of Artificial Sequence: example ZFP
DRSNLER

SEQ ID NO: 279 - protein, 7 aa, Artificial Sequence
  Description of Artificial Sequence: example ZFP
DHANLAR

SEQ ID NO: 280 - protein, 7 aa, Artificial Sequence
  Description of Artificial Sequence: example ZFP
DHANLAR

SEQ ID NO: 281 - protein, 7 aa, Artificial Sequence
  Description of Artificial Sequence: example ZFP
DSGHLTR

SEQ ID NO: 282 - protein, 7 aa, Artificial Sequence
  Description of Artificial Sequence: example ZFP
DSGHLTR

SEQ ID NO: 283 - protein, 7 aa, Artificial Sequence
  Description of Artificial Sequence: example ZFP
DSGHLTR

SEQ ID NO: 284 - protein, 7 aa, Artificial Sequence
  Description of Artificial Sequence: example ZFP
DSGHLTR

SEQ ID NO: 285 - protein, 7 aa, Artificial Sequence
  Description of Artificial Sequence: example ZFP
RSDHLTT

SEQ ID NO: 286 - protein, 7 aa, Artificial Sequence
  Description of Artificial Sequence: example ZFP
RSKNLQR

SEQ ID NO: 287 - protein, 7 aa, Artificial Sequence
  Description of Artificial Sequence: example ZFP
QSGHLQR

SEQ ID NO: 288 - protein, 7 aa, Artificial Sequence
  Description of Artificial Sequence: example ZFP
QSSDLQK

SEQ ID NO: 289 - protein, 7 aa, Artificial Sequence
  Description of Artificial Sequence: example ZFP
RGDALTS

SEQ ID NO: 290 - protein, 7 aa, Artificial Sequence
  Description of Artificial Sequence: example ZFP
QSGHLQR

SEQ ID NO: 291 - protein, 7 aa, Artificial Sequence
  Description of Artificial Sequence: example ZFP
DRSNLRT

SEQ ID NO: 292 - protein, 7 aa, Artificial Sequence
  Description of Artificial Sequence: example ZFP
RSDNLAR

SEQ ID NO: 293 - protein, 7 aa, Artificial Sequence
  Description of Artificial Sequence: example ZFP
RSDNLAR

SEQ ID NO: 294 - protein, 7 aa, Artificial Sequence
  Description of Artificial Sequence: example ZFP
QSSDLQR

SEQ ID NO: 295 - protein, 7 aa, Artificial Sequence
  Description of Artificial Sequence: example ZFP
QSSDLQR

SEQ ID NO: 296 - protein, 7 aa, Artificial Sequence
  Description of Artificial Sequence: example ZFP
QSSDLQR

SEQ ID NO: 297 - protein, 7 aa, Artificial Sequence
  Description of Artificial Sequence: example ZFP
RSDNLAR

SEQ ID NO: 298 - protein, 7 aa, Artificial Sequence
  Description of Artificial Sequence: example ZFP
DRSALAR

SEQ ID NO: 299 - protein, 7 aa, Artificial Sequence
  Description of Artificial Sequence: example ZFP
RSDNLAR

SEQ ID NO: 300 - protein, 7 aa, Artificial Sequence
  Description of Artificial Sequence: example ZFP
RSDNLAR

SEQ ID NO: 301 - protein, 7 aa, Artificial Sequence
  Description of Artificial Sequence: example ZFP
RSDNLAR

SEQ ID NO: 302 - protein, 7 aa, Artificial Sequence
  Description of Artificial Sequence: example ZFP
RSDELQR

SEQ ID NO: 303 - protein, 7 aa, Artificial Sequence
  Description of Artificial Sequence: example ZFP
RADTLRR

SEQ ID NO: 304 - protein, 7 aa, Artificial Sequence
  Description of Artificial Sequence: example ZFP
ESSKLKR

SEQ ID NO: 305 - protein, 7 aa, Artificial Sequence
  Description of Artificial Sequence: example ZFP
ESSKLKR

SEQ ID NO: 306 - protein, 7 aa, Artificial Sequence
  Description of Artificial Sequence: example ZFP
RSDNLAR

SEQ ID NO: 307 - protein, 7 aa, Artificial Sequence
  Description of Artificial Sequence: example ZFP
RSDNLAR

SEQ ID NO: 308 - protein, 7 aa, Artificial Sequence
  Description of Artificial Sequence: example ZFP
RSDNLTT

SEQ ID NO: 309 - protein, 7 aa, Artificial Sequence
  Description of Artificial Sequence: example ZFP
RSDHLTR

SEQ ID NO: 310 - protein, 7 aa, Artificial Sequence
  Description of Artificial Sequence: example ZFP
RSDNLAR

SEQ ID NO: 311 - protein, 7 aa, Artificial Sequence
  Description of Artificial Sequence: example ZFP
RSDNLAR

SEQ ID NO: 312 - protein, 7 aa, Artificial Sequence
  Description of Artificial Sequence: example ZFP
RSDNLAR

SEQ ID NO: 313 - protein, 7 aa, Artificial Sequence
  Description of Artificial Sequence: example ZFP
ERGHLTR

SEQ ID NO: 314 - protein, 7 aa, Artificial Sequence
  Description of Artificial Sequence: example ZFP
MSHHLKE

SEQ ID NO: 315 - protein, 7 aa, Artificial Sequence
  Description of Artificial Sequence: example ZFP
MSHHLKE

SEQ ID NO: 316 - protein, 7 aa, Artificial Sequence
  Description of Artificial Sequence: example ZFP
TSDHLAS

SEQ ID NO: 317 - protein, 7 aa, Artificial Sequence
  Description of Artificial Sequence: example ZFP
MSHHLKT

SEQ ID NO: 318 - protein, 7 aa, Artificial Sequence
  Description of Artificial Sequence: example ZFP
TSGHLTS

SEQ ID NO: 319 - protein, 7 aa, Artificial Sequence
  Description of Artificial Sequence: example ZFP
MSHHLKT

SEQ ID NO: 320 - protein, 7 aa, Artificial Sequence
  Description of Artificial Sequence: example ZFP
MSHHLKE

SEQ ID NO: 321 - protein, 7 aa, Artificial Sequence
  Description of Artificial Sequence: example ZFP
TKDHLAS

SEQ ID NO: 322 - protein, 7 aa, Artificial Sequence
  Description of Artificial Sequence: example ZFP
MSHHLKT

SEQ ID NO: 323 - protein, 7 aa, Artificial Sequence
  Description of Artificial Sequence: example ZFP
MSHHLKT

SEQ ID NO: 324 - protein, 7 aa, Artificial Sequence
  Description of Artificial Sequence: example ZFP
MSHHLKE

SEQ ID NO: 325 - protein, 7 aa, Artificial Sequence
  Description of Artificial Sequence: example ZFP
TSDHLAS

SEQ ID NO: 326 - protein, 7 aa, Artificial Sequence
  Description of Artificial Sequence: example ZFP
RSDHLTR

SEQ ID NO: 327 - protein, 7 aa, Artificial Sequence
  Description of Artificial Sequence: example ZFP
TSDHLAS

SEQ ID NO: 328 - protein, 7 aa, Artificial Sequence
  Description of Artificial Sequence: example ZFP
MSHHLKT

SEQ ID NO: 329 - protein, 7 aa, Artificial Sequence
  Description of Artificial Sequence: example ZFP
MSHHLKE

SEQ ID NO: 330 - protein, 7 aa, Artificial Sequence
  Description of Artificial Sequence: example ZFP
TSGHLTS

SEQ ID NO: 331 - protein, 7 aa, Artificial Sequence
  Description of Artificial Sequence: example ZFP
TSSELQR

SEQ ID NO: 332 - protein, 7 aa, Artificial Sequence
  Description of Artificial Sequence: example ZFP
TSANLSR

SEQ ID NO: 333 - protein, 7 aa, Artificial Sequence
  Description of Artificial Sequence: example ZFP
DSSNLTR

SEQ ID NO: 334 - protein, 7 aa, Artificial Sequence
  Description of Artificial Sequence: example ZFP
TGGSLAR

SEQ ID NO: 335 - protein, 7 aa, Artificial Sequence
  Description of Artificial Sequence: example ZFP
RSDELRR

SEQ ID NO: 336 - protein, 7 aa, Artificial Sequence
  Description of Artificial Sequence: example ZFP
RSDTLKK

SEQ ID NO: 337 - protein, 7 aa, Artificial Sequence
  Description of Artificial Sequence: example ZFP
RSDELRR

SEQ ID NO: 338 - protein, 7 aa, Artificial Sequence
  Description of Artificial Sequence: example ZFP
RSDELRR

SEQ ID NO: 339 - protein, 7 aa, Artificial Sequence
  Description of Artificial Sequence: example ZFP
QRAHLAR

SEQ ID NO: 340 - protein, 7 aa, Artificial Sequence
  Description of Artificial Sequence: example ZFP
RSDELRR

SEQ ID NO: 341 - protein, 7 aa, Artificial Sequence
  Description of Artificial Sequence: example ZFP
RSDELRR

SEQ ID NO: 342 - protein, 7 aa, Artificial Sequence
  Description of Artificial Sequence: example ZFP
QSGSLTR

SEQ ID NO: 343 - protein, 7 aa, Artificial Sequence
  Description of Artificial Sequence: example ZFP
RSDNLSR

SEQ ID NO: 344 - protein, 7 aa, Artificial Sequence
  Description of Artificial Sequence: example ZFP
RSDELRR

SEQ ID NO: 345 - protein, 7 aa, Artificial Sequence
  Description of Artificial Sequence: example ZFP
RSDTLKK

SEQ ID NO: 346 - protein, 7 aa, Artificial Sequence
  Description of Artificial Sequence: example ZFP
RSDALAR

SEQ ID NO: 347 - protein, 7 aa, Artificial Sequence
  Description of Artificial Sequence: example ZFP
RSDALAR

SEQ ID NO: 348 - protein, 7 aa, Artificial Sequence
  Description of Artificial Sequence: example ZFP
RSDHLTR

SEQ ID NO: 349 - protein, 7 aa, Artificial Sequence
  Description of Artificial Sequence: example ZFP
RSDHLTR

SEQ ID NO: 350 - protein, 7 aa, Artificial Sequence
  Description of Artificial Sequence: example ZFP
QSGSLTR

SEQ ID NO: 351 - protein, 7 aa, Artificial Sequence
  Description of Artificial Sequence: example ZFP
ERQHLAT

SEQ ID NO: 352 - protein, 7 aa, Artificial Sequence
  Description of Artificial Sequence: example ZFP
ERDHLRT

SEQ ID NO: 353 - protein, 7 aa, Artificial Sequence
  Description of Artificial Sequence: example ZFP
ERQHLAT

SEQ ID NO: 354 - protein, 7 aa, Artificial Sequence
  Description of Artificial Sequence: example ZFP
ERDHLRT

SEQ ID NO: 355 - protein, 7 aa, Artificial Sequence
  Description of Artificial Sequence: example ZFP
ERQHLAT

SEQ ID NO: 356 - protein, 7 aa, Artificial Sequence
  Description of Artificial Sequence: example ZFP
ERDHLRT

SEQ ID NO: 357 - protein, 7 aa, Artificial Sequence
  Description of Artificial Sequence: example ZFP
ERQHLAT

SEQ ID NO: 358 - protein, 7 aa, Artificial Sequence
  Description of Artificial Sequence: example ZFP
ERDHLRT

SEQ ID NO: 359 - protein, 7 aa, Artificial Sequence
  Description of Artificial Sequence: example ZFP
ERQHLAT

SEQ ID NO: 360 - protein, 7 aa, Artificial Sequence
  Description of Artificial Sequence: example ZFP
ERDHLRT

SEQ ID NO: 361 - protein, 7 aa, Artificial Sequence
  Description of Artificial Sequence: example ZFP
ERQHLAT

SEQ ID NO: 362 - protein, 7 aa, Artificial Sequence
  Description of Artificial Sequence: example ZFP
ERDHLRT

SEQ ID NO: 363 - protein, 7 aa, Artificial Sequence
  Description of Artificial Sequence: example ZFP
RSDHLQR

SEQ ID NO: 364 - protein, 7 aa, Artificial Sequence
  Description of Artificial Sequence: example ZFP
RSDNLTR

SEQ ID NO: 365 - protein, 7 aa, Artificial Sequence
  Description of Artificial Sequence: example ZFP
QSGSLTR

SEQ ID NO: 366 - protein, 7 aa, Artificial Sequence
  Description of Artificial Sequence: example ZFP
QSASLTR

SEQ ID NO: 367 - protein, 7 aa, Artificial Sequence
  Description of Artificial Sequence: example ZFP
QSGSLTR

SEQ ID NO: 368 - protein, 7 aa, Artificial Sequence
  Description of Artificial Sequence: example ZFP
QSASLTR

SEQ ID NO: 369 - protein, 7 aa, Artificial Sequence
  Description of Artificial Sequence: example ZFP
QSASLTR

SEQ ID NO: 370 - protein, 7 aa, Artificial Sequence
  Description of Artificial Sequence: example ZFP
TSSELQR

SEQ ID NO: 371 - protein, 7 aa, Artificial Sequence
  Description of Artificial Sequence: example ZFP
RSDNLTR

SEQ ID NO: 372 - protein, 7 aa, Artificial Sequence
  Description of Artificial Sequence: example ZFP
QSASLTR

SEQ ID NO: 373 - protein, 7 aa, Artificial Sequence
  Description of Artificial Sequence: example ZFP
QSGSLTR

SEQ ID NO: 374 - protein, 7 aa, Artificial Sequence
  Description of Artificial Sequence: example ZFP
QSGSLTR

SEQ ID NO: 375 - protein, 7 aa, Artificial Sequence
  Description of Artificial Sequence: example ZFP
QSGSLTR

SEQ ID NO: 376 - protein, 7 aa, Artificial Sequence
  Description of Artificial Sequence: example ZFP
QRSALAR

SEQ ID NO: 377 - protein, 7 aa, Artificial Sequence
  Description of Artificial Sequence: example ZFP
TSANLSR

SEQ ID NO: 378 - protein, 7 aa, Artificial Sequence
  Description of Artificial Sequence: example ZFP
QQSNLAR

SEQ ID NO: 379 - protein, 7 aa, Artificial Sequence
  Description of Artificial Sequence: example ZFP
TSANLSR

SEQ ID NO: 380 - protein, 7 aa, Artificial Sequence
  Description of Artificial Sequence: example ZFP
QSSDLQR

SEQ ID NO: 381 - protein, 7 aa, Artificial Sequence
  Description of Artificial Sequence: example ZFP
QRSNLVR

SEQ ID NO: 382 - protein, 7 aa, Artificial Sequence
  Description of Artificial Sequence: example ZFP
QRSNLVR

SEQ ID NO: 383 - protein, 7 aa, Artificial Sequence
  Description of Artificial Sequence: example ZFP
QQSNLAR

SEQ ID NO: 384 - protein, 7 aa, Artificial Sequence
  Description of Artificial Sequence: example ZFP
DSSNLTR

SEQ ID NO: 385 - protein, 7 aa, Artificial Sequence
  Description of Artificial Sequence: example ZFP
DSSNLTR

SEQ ID NO: 386 - protein, 7 aa, Artificial Sequence
  Description of Artificial Sequence: example ZFP
DSSNLTR

SEQ ID NO: 387 - protein, 7 aa, Artificial Sequence
  Description of Artificial Sequence: example ZFP
EKANLTR

SEQ ID NO: 388 - protein, 7 aa, Artificial Sequence
  Description of Artificial Sequence: example ZFP
ERGNLTR

SEQ ID NO: 389 - protein, 7 aa, Artificial Sequence
  Description of Artificial Sequence: example ZFP
EKANLTR

SEQ ID NO: 390 - protein, 7 aa, Artificial Sequence
  Description of Artificial Sequence: example ZFP
ERGNLTR

SEQ ID NO: 391 - protein, 7 aa, Artificial Sequence
  Description of Artificial Sequence: example ZFP
RSDNLTR

SEQ ID NO: 392 - protein, 7 aa, Artificial Sequence
  Description of Artificial Sequence: example ZFP
ERGTLAR

SEQ ID NO: 393 - protein, 7 aa, Artificial Sequence
  Description of Artificial Sequence: example ZFP
TSGHLTR

SEQ ID NO: 394 - protein, 7 aa, Artificial Sequence
  Description of Artificial Sequence: example ZFP
DSGSLTR

SEQ ID NO: 395 - protein, 7 aa, Artificial Sequence
  Description of Artificial Sequence: example ZFP
DRSNLTR

SEQ ID NO: 396 - protein, 7 aa, Artificial Sequence
  Description of Artificial Sequence: example ZFP
DSSKLSR

SEQ ID NO: 397 - protein, 7 aa, Artificial Sequence
  Description of Artificial Sequence: example ZFP
RSDNLAR

SEQ ID NO: 398 - protein, 7 aa, Artificial Sequence
  Description of Artificial Sequence: example ZFP
RSDALAR

SEQ ID NO: 399 - protein, 7 aa, Artificial Sequence
  Description of Artificial Sequence: example ZFP
RSDSLAR

SEQ ID NO: 400 - protein, 7 aa, Artificial Sequence
  Description of Artificial Sequence: example ZFP
RSDNLRE

SEQ ID NO: 401 - protein, 7 aa, Artificial Sequence
  Description of Artificial Sequence: example ZFP
RGDHLKD

SEQ ID NO: 402 - protein, 7 aa, Artificial Sequence
  Description of Artificial Sequence: example ZFP
RGDHLKD

SEQ ID NO: 403 - protein, 7 aa, Artificial Sequence
  Description of Artificial Sequence: example ZFP
QSGNLTR

SEQ ID NO: 404 - protein, 7 aa, Artificial Sequence
  Description of Artificial Sequence: example ZFP
RSDNLAR

SEQ ID NO: 405 - protein, 7 aa, Artificial Sequence
  Description of Artificial Sequence: example ZFP
QSDHLTR

SEQ ID NO: 406 - protein, 7 aa, Artificial Sequence
  Description of Artificial Sequence: example ZFP
QRAHLAR

SEQ ID NO: 407 - protein, 7 aa, Artificial Sequence
  Description of Artificial Sequence: example ZFP
QSGHLRR

SEQ ID NO: 408 - protein, 7 aa, Artificial Sequence
  Description of Artificial Sequence: example ZFP
RSDALAR

SEQ ID NO: 409 - protein, 7 aa, Artificial Sequence
  Description of Artificial Sequence: example ZFP
RSDALAR

SEQ ID NO: 410 - protein, 7 aa, Artificial Sequence
  Description of Artificial Sequence: example ZFP
RSDNLAR

SEQ ID NO: 411 - protein, 7 aa, Artificial Sequence
  Description of Artificial Sequence: example ZFP
RSDNLAR

SEQ ID NO: 412 - protein, 7 aa, Artificial Sequence
  Description of Artificial Sequence: example ZFP
QRAHLAR

SEQ ID NO: 413 - protein, 7 aa, Artificial Sequence
  Description of Artificial Sequence: example ZFP
QSGHLAR

SEQ ID NO: 414 - protein, 7 aa, Artificial Sequence
  Description of Artificial Sequence: example ZFP
RSDHLTT

SEQ ID NO: 415 - protein, 7 aa, Artificial Sequence
  Description of Artificial Sequence: example ZFP
RSDNLTT

SEQ ID NO: 416 - protein, 7 aa, Artificial Sequence
  Description of Artificial Sequence: example ZFP
ERGTLAR

SEQ ID NO: 417 - protein, 7 aa, Artificial Sequence
  Description of Artificial Sequence: example ZFP
DRSDLTR

SEQ ID NO: 418 - protein, 7 aa, Artificial Sequence
  Description of Artificial Sequence: example ZFP
DCRDLAR

SEQ ID NO: 419 - protein, 7 aa, Artificial Sequence
  Description of Artificial Sequence: example ZFP
RSDTLKK

SEQ ID NO: 420 - protein, 7 aa, Artificial Sequence
  Description of Artificial Sequence: example ZFP
RSDHLSR

SEQ ID NO: 421 - protein, 7 aa, Artificial Sequence
  Description of Artificial Sequence: example ZFP
RSDNLAR

SEQ ID NO: 422 - protein, 7 aa, Artificial Sequence
  Description of Artificial Sequence: example ZFP
RSDNLTR

SEQ ID NO: 423 - protein, 7 aa, Artificial Sequence
  Description of Artificial Sequence: example ZFP
RLDGLRT

SEQ ID NO: 424 - protein, 7 aa, Artificial Sequence
  Description of Artificial Sequence: example ZFP
RSDNLTR

SEQ ID NO: 425 - protein, 7 aa, Artificial Sequence
  Description of Artificial Sequence: example ZFP
RSDHLSR

SEQ ID NO: 426 - protein, 7 aa, Artificial Sequence
  Description of Artificial Sequence: example ZFP
RSDHLSR

SEQ ID NO: 427 - protein, 7 aa, Artificial Sequence
  Description of Artificial Sequence: example ZFP
RSDNLTR

SEQ ID NO: 428 - protein, 7 aa, Artificial Sequence
  Description of Artificial Sequence: example ZFP
RSDHLSR

SEQ ID NO: 429 - protein, 7 aa, Artificial Sequence
  Description of Artificial Sequence: example ZFP
RSDNLTR

SEQ ID NO: 430 - protein, 7 aa, Artificial Sequence
  Description of Artificial Sequence: example ZFP
RSDNLTR

SEQ ID NO: 431 - protein, 7 aa, Artificial Sequence
  Description of Artificial Sequence: example ZFP
RSDNLAR

SEQ ID NO: 432 - protein, 7 aa, Artificial Sequence
  Description of Artificial Sequence: example ZFP
DSGHLAS

SEQ ID NO: 433 - protein, 7 aa, Artificial Sequence
  Description of Artificial Sequence: example ZFP
RSDNLAR

SEQ ID NO: 434 - protein, 7 aa, Artificial Sequence
  Description of Artificial Sequence: example ZFP
RSDHLSR

SEQ ID NO: 435 - protein, 7 aa, Artificial Sequence
  Description of Artificial Sequence: example ZFP
RSDNLAR

SEQ ID NO: 436 - protein, 7 aa, Artificial Sequence
  Description of Artificial Sequence: example ZFP
RSDNLAR

SEQ ID NO: 437 - protein, 7 aa, Artificial Sequence
  Description of Artificial Sequence: example ZFP
QQSNLAR

SEQ ID NO: 438 - protein, 7 aa, Artificial Sequence
  Description of Artificial Sequence: example ZFP
QRSNLVR

SEQ ID NO: 439 - protein, 7 aa, Artificial Sequence
  Description of Artificial Sequence: example ZFP
TSANLSR

SEQ ID NO: 440 - protein, 7 aa, Artificial Sequence
  Description of Artificial Sequence: example ZFP
QRSALTR

SEQ ID NO: 441 - DNA, 9 bp, Artificial Sequence
  Description of Artificial Sequence: example target DNA
gcagccttg

SEQ ID NO: 442 - DNA, 9 bp, Artificial Sequence
  Description of Artificial Sequence: example target DNA
gcagccttg

SEQ ID NO: 443 - DNA, 9 bp, Artificial Sequence
  Description of Artificial Sequence: example target DNA
gcagccttg

SEQ ID NO: 444 - DNA, 9 bp, Artificial Sequence
  Description of Artificial Sequence: example target DNA
gcagccttg

SEQ ID NO: 445 - DNA, 9 bp, Artificial Sequence
  Description of Artificial Sequence: example target DNA
gaggtagaa

SEQ ID NO: 446 - DNA, 9 bp, Artificial Sequence
  Description of Artificial Sequence: example target DNA
gaggtagaa

SEQ ID NO: 447 - DNA, 9 bp, Artificial Sequence
  Description of Artificial Sequence: example target DNA
gagtggtta

SEQ ID NO: 448 - DNA, 9 bp, Artificial Sequence
  Description of Artificial Sequence: example target DNA
taggtctta

SEQ ID NO: 449 - DNA, 9 bp, Artificial Sequence
  Description of Artificial Sequence: example target DNA
ggagtggtt

SEQ ID NO: 450 - DNA, 9 bp, Artificial Sequence
  Description of Artificial Sequence: example target DNA
ggagtggtt

SEQ ID NO: 451 - DNA, 9 bp, Artificial Sequence
  Description of Artificial Sequence: example target DNA
ggagtggtt

SEQ ID NO: 452 - DNA, 9 bp, Artificial Sequence
  Description of Artificial Sequence: example target DNA
ggagtggtt

SEQ ID NO: 453 - DNA, 9 bp, Artificial Sequence
  Description of Artificial Sequence: example target DNA
gttgctgga

SEQ ID NO: 454 - DNA, 9 bp, Artificial Sequence
  Description of Artificial Sequence: example target DNA
gttgctgga

SEQ ID NO: 455 - DNA, 9 bp, Artificial Sequence
  Description of Artificial Sequence: example target DNA
gaagtctgt

SEQ ID NO: 456 - DNA, 9 bp, Artificial Sequence
  Description of Artificial Sequence: example target DNA
gaagtctgt

SEQ ID NO: 457 - DNA, 9 bp, Artificial Sequence
  Description of Artificial Sequence: example target DNA
gaggtcgta

SEQ ID NO: 458 - DNA, 9 bp, Artificial Sequence
  Description of Artificial Sequence: example target DNA
gatgttgat

SEQ ID NO: 459 - DNA, 9 bp, Artificial Sequence
  Description of Artificial Sequence: example target DNA
gatgttgat

SEQ ID NO: 460 - DNA, 9 bp, Artificial Sequence
  Description of Artificial Sequence: example target DNA
gatgagtac

SEQ ID NO: 461 - DNA, 9 bp, Artificial Sequence
  Description of Artificial Sequence: example target DNA
gatgagtac

SEQ ID NO: 462 - DNA, 9 bp, Artificial Sequence
  Description of Artificial Sequence: example target DNA
gatgagtac

SEQ ID NO: 463 - DNA, 9 bp, Artificial Sequence
  Description of Artificial Sequence: example target DNA
gatgagtac

SEQ ID NO: 464 - DNA, 9 bp, Artificial Sequence
  Description of Artificial Sequence: example target DNA
tgggaggtc

SEQ ID NO: 465 - DNA, 9 bp, Artificial Sequence
  Description of Artificial Sequence: example target DNA
gcagccttg

SEQ ID NO: 466 - DNA, 9 bp, Artificial Sequence
  Description of Artificial Sequence: example target DNA
gcagccttg

SEQ ID NO: 467 - DNA, 9 bp, Artificial Sequence
  Description of Artificial Sequence: example target DNA
gcagccttg

SEQ ID NO: 468 - DNA, 9 bp, Artificial Sequence
  Description of Artificial Sequence: example target DNA
gcagccttg

SEQ ID NO: 469 - DNA, 9 bp, Artificial Sequence
  Description of Artificial Sequence: example target DNA
gcagccttg

SEQ ID NO: 470 - DNA, 9 bp, Artificial Sequence
  Description of Artificial Sequence: example target DNA
gcagccttg

SEQ ID NO: 471 - DNA, 9 bp, Artificial Sequence
  Description of Artificial Sequence: example target DNA
ggtgtggtg

SEQ ID NO: 472 - DNA, 9 bp, Artificial Sequence
  Description of Artificial Sequence: example target DNA
ggtgtggtg

SEQ ID NO: 473 - DNA, 9 bp, Artificial Sequence
  Description of Artificial Sequence: example target DNA
gtagaggtg

SEQ ID NO: 474 - DNA, 9 bp, Artificial Sequence
  Description of Artificial Sequence: example target DNA
ggggagggg

SEQ ID NO: 475 - DNA, 9 bp, Artificial Sequence
  Description of Artificial Sequence: example target DNA
ggggaggcc

SEQ ID NO: 476 - DNA, 9 bp, Artificial Sequence
  Description of Artificial Sequence: example target DNA
ggggaggcc

SEQ ID NO: 477 - DNA, 9 bp, Artificial Sequence
  Description of Artificial Sequence: example target DNA
ggcggggag

SEQ ID NO: 478 - DNA, 9 bp, Artificial Sequence
  Description of Artificial Sequence: example target DNA
gcaggggag

SEQ ID NO: 479 - DNA, 9 bp, Artificial Sequence
  Description of Artificial Sequence: example target DNA
gggggtgct

SEQ ID NO: 480 - DNA, 9 bp, Artificial Sequence
  Description of Artificial Sequence: example target DNA
gtgggcgct

SEQ ID NO: 481 - DNA, 9 bp, Artificial Sequence
  Description of Artificial Sequence: example target DNA
taagaaggg

SEQ ID NO: 482 - DNA, 9 bp, Artificial Sequence
  Description of Artificial Sequence: example target DNA
taagaaggg

SEQ ID NO: 483 - DNA, 9 bp, Artificial Sequence
  Description of Artificial Sequence: example target DNA
gaaggggag

SEQ ID NO: 484 - DNA, 9 bp, Artificial Sequence
  Description of Artificial Sequence: example target DNA
gaaggggag

SEQ ID NO: 485 - DNA, 9 bp, Artificial Sequence
  Description of Artificial Sequence: example target DNA
gcggccgcg

SEQ ID NO: 486 - DNA, 9 bp, Artificial Sequence
  Description of Artificial Sequence: example target DNA
gcggccgcg

SEQ ID NO: 487 - DNA, 9 bp, Artificial Sequence
  Description of Artificial Sequence: example target DNA
gcggccgcg

SEQ ID NO: 488 - DNA, 9 bp, Artificial Sequence
  Description of Artificial Sequence: example target DNA
gcggccgcg

SEQ ID NO: 489 - DNA, 9 bp, Artificial Sequence
  Description of Artificial Sequence: example target DNA
gcggccgcg

SEQ ID NO: 490 - DNA, 9 bp, Artificial Sequence
  Description of Artificial Sequence: example target DNA
gcggccgcg

SEQ ID NO: 491 - DNA, 9 bp, Artificial Sequence
  Description of Artificial Sequence: example target DNA
gcagaagtg

SEQ ID NO: 492 - DNA, 9 bp, Artificial Sequence
  Description of Artificial Sequence: example target DNA
gcagaagtg

SEQ ID NO: 493 - DNA, 9 bp, Artificial Sequence
  Description of Artificial Sequence: example target DNA
gcggccgcg

SEQ ID NO: 494 - DNA, 9 bp, Artificial Sequence
  Description of Artificial Sequence: example target DNA
tgtgcggcc

SEQ ID NO: 495 - DNA, 9 bp, Artificial Sequence
  Description of Artificial Sequence: example target DNA
gcagaagcg

SEQ ID NO: 496 - DNA, 9 bp, Artificial Sequence
  Description of Artificial Sequence: example target DNA
gcagaagcg

SEQ ID NO: 497 - DNA, 9 bp, Artificial Sequence
  Description of Artificial Sequence: example target DNA
gcagaagcg

SEQ ID NO: 498 - DNA, 9 bp, Artificial Sequence
  Description of Artificial Sequence: example target DNA
gcagaagcg

SEQ ID NO: 499 - DNA, 9 bp, Artificial Sequence
  Description of Artificial Sequence: example target DNA
gcagaagcg

SEQ ID NO: 500 - DNA, 9 bp, Artificial Sequence
  Description of Artificial Sequence: example target DNA
gtgtgcggc

SEQ ID NO: 501 - DNA, 9 bp, Artificial Sequence
  Description of Artificial Sequence: example target DNA
tgcgcggcc

SEQ ID NO: 502 - DNA, 9 bp, Artificial Sequence
  Description of Artificial Sequence: example target DNA
tgcgcggcc

SEQ ID NO: 503 - DNA, 9 bp, Artificial Sequence
  Description of Artificial Sequence: example target DNA
gcttaggca

SEQ ID NO: 504 - DNA, 9 bp, Artificial Sequence
  Description of Artificial Sequence: example target DNA
gcttaggca

SEQ ID NO: 505 - DNA, 9 bp, Artificial Sequence
  Description of Artificial Sequence: example target DNA
gcttaggca

SEQ ID NO: 506 - DNA, 9 bp, Artificial Sequence
  Description of Artificial Sequence: example target DNA
gcttaggca

SEQ ID NO: 507 - DNA, 9 bp, Artificial Sequence
  Description of Artificial Sequence: example target DNA
gcttaggca

SEQ ID NO: 508 - DNA, 9 bp, Artificial Sequence
  Description of Artificial Sequence: example target DNA
gcttaggca

SEQ ID NO: 509 - DNA, 9 bp, Artificial Sequence
  Description of Artificial Sequence: example target DNA
gcttaggca

SEQ ID NO: 510 - DNA, 9 bp, Artificial Sequence
  Description of Artificial Sequence: example target DNA
gcttaggca

SEQ ID NO: 511 - DNA, 9 bp, Artificial Sequence
  Description of Artificial Sequence: example target DNA
gcttaggca

SEQ ID NO: 512 - DNA, 9 bp, Artificial Sequence
  Description of Artificial Sequence: example target DNA
gaagaagcg

SEQ ID NO: 513 - DNA, 9 bp, Artificial Sequence
  Description of Artificial Sequence: example target DNA
gaagaagcg

SEQ ID NO: 514 - DNA, 9 bp, Artificial Sequence
  Description of Artificial Sequence: example target DNA
ggagatgcc

SEQ ID NO: 515 - DNA, 9 bp, Artificial Sequence
  Description of Artificial Sequence: example target DNA
ggagatgcc

SEQ ID NO: 516 - DNA, 9 bp, Artificial Sequence
  Description of Artificial Sequence: example target DNA
ggagatgcc

SEQ ID NO: 517 - DNA, 9 bp, Artificial Sequence
  Description of Artificial Sequence: example target DNA
ggagatgcc

SEQ ID NO: 518 - DNA, 9 bp, Artificial Sequence
  Description of Artificial Sequence: example target DNA
ggagatgcc

SEQ ID NO: 519 - DNA, 9 bp, Artificial Sequence
  Description of Artificial Sequence: example target DNA
ggagatgcc

SEQ ID NO: 520 - DNA, 9 bp, Artificial Sequence
  Description of Artificial Sequence: example target DNA
ggagatgcc

SEQ ID NO: 521 - DNA, 9 bp, Artificial Sequence
  Description of Artificial Sequence: example target DNA
ggagatgcc

SEQ ID NO: 522 - DNA, 10 bp, Artificial Sequence
  Description of Artificial Sequence: example target DNA
taggagatgc

SEQ ID NO: 523 - DNA, 9 bp, Artificial Sequence
  Description of Artificial Sequence: example target DNA
ggggaaggg

SEQ ID NO: 524 - DNA, 9 bp, Artificial Sequence
  Description of Artificial Sequence: example target DNA
ggggaaggg

SEQ ID NO: 525 - DNA, 9 bp, Artificial Sequence
  Description of Artificial Sequence: example target DNA
ggcggagat

SEQ ID NO: 526 - DNA, 9 bp, Artificial Sequence
  Description of Artificial Sequence: example target DNA
ggcggagat

SEQ ID NO: 527 - DNA, 9 bp, Artificial Sequence
  Description of Artificial Sequence: example target DNA
ggcggagat

SEQ ID NO: 528 - DNA, 9 bp, Artificial Sequence
  Description of Artificial Sequence: example target DNA
gtatctgct

SEQ ID NO: 529 - DNA, 9 bp, Artificial Sequence
  Description of Artificial Sequence: example target DNA
gtatctgtt

SEQ ID NO: 530 - DNA, 9 bp, Artificial Sequence
  Description of Artificial Sequence: example target DNA
tctgctggg

SEQ ID NO: 531 - DNA, 9 bp, Artificial Sequence
  Description of Artificial Sequence: example target DNA
tctgttggg

SEQ ID NO: 532 - DNA, 9 bp, Artificial Sequence
  Description of Artificial Sequence: example target DNA
ggtgtcgcc

SEQ ID NO: 533 - DNA, 9 bp, Artificial Sequence
  Description of Artificial Sequence: example target DNA
tccgagggt

SEQ ID NO: 534 - DNA, 9 bp, Artificial Sequence
  Description of Artificial Sequence: example target DNA
gctggtgtc

SEQ ID NO: 535 - DNA, 9 bp, Artificial Sequence
  Description of Artificial Sequence: example target DNA
ggaggggtg

SEQ ID NO: 536 - DNA, 9 bp, Artificial Sequence
  Description of Artificial Sequence: example target DNA
gttggagcc

SEQ ID NO: 537 - DNA, 9 bp, Artificial Sequence
  Description of Artificial Sequence: example target DNA
gaagaggac

SEQ ID NO: 538 - DNA, 9 bp, Artificial Sequence
  Description of Artificial Sequence: example target DNA
gaagaggac

SEQ ID NO: 539 - DNA, 9 bp, Artificial Sequence
  Description of Artificial Sequence: example target DNA
ggctgggcg

SEQ ID NO: 540 - DNA, 9 bp, Artificial Sequence
  Description of Artificial Sequence: example target DNA
ggctgggcg

SEQ ID NO: 541 - DNA, 9 bp, Artificial Sequence
  Description of Artificial Sequence: example target DNA
ggctgggcg

SEQ ID NO: 542 - DNA, 9 bp, Artificial Sequence
  Description of Artificial Sequence: example target DNA
gggtttggg

SEQ ID NO: 543 - DNA, 9 bp, Artificial Sequence
  Description of Artificial Sequence: example target DNA
gggtttggg

SEQ ID NO: 544 - DNA, 10 bp, Artificial Sequence
  Description of Artificial Sequence: example target DNA
gtgtccgaag

SEQ ID NO: 545 - DNA, 9 bp, Artificial Sequence
  Description of Artificial Sequence: example target DNA
ggtgctggt

SEQ ID NO: 546 - DNA, 9 bp, Artificial Sequence
  Description of Artificial Sequence: example target DNA
gagggtgct

SEQ ID NO: 547 - DNA, 9 bp, Artificial Sequence
  Description of Artificial Sequence: example target DNA
gggggcggg

SEQ ID NO: 548 - DNA, 9 bp, Artificial Sequence
  Description of Artificial Sequence: example target DNA
gagggggcg

SEQ ID NO: 549 - DNA, 9 bp, Artificial Sequence
  Description of Artificial Sequence: example target DNA
gtagttgtg

SEQ ID NO: 550 - DNA, 9 bp, Artificial Sequence
  Description of Artificial Sequence: example target DNA
gtagttgtg

SEQ ID NO: 551 - DNA, 9 bp, Artificial Sequence
  Description of Artificial Sequence: example target DNA
gtagttgtg

SEQ ID NO: 552 - DNA, 9 bp, Artificial Sequence
  Description of Artificial Sequence: example target DNA
gtagttgtg

SEQ ID NO: 553 - DNA, 9 bp, Artificial Sequence
  Description of Artificial Sequence: example target DNA
gtagttgtg

SEQ ID NO: 554 - DNA, 9 bp, Artificial Sequence
  Description of Artificial Sequence: example target DNA
gctgaggaa

SEQ ID NO: 555 - DNA, 9 bp, Artificial Sequence
  Description of Artificial Sequence: example target DNA
gaggaagat

SEQ ID NO: 556 - DNA, 10 bp, Artificial Sequence
  Description of Artificial Sequence: example target DNA
gtgttggcag

SEQ ID NO: 557 - DNA, 10 bp, Artificial Sequence
  Description of Artificial Sequence: example target DNA
gccgaggaga

SEQ ID NO: 558 - DNA, 10 bp, Artificial Sequence
  Description of Artificial Sequence: example target DNA
gccgaggaga

SEQ ID NO: 559 - DNA, 10 bp, Artificial Sequence
  Description of Artificial Sequence: example target DNA
gagtcggaag

SEQ ID NO: 560 - DNA, 10 bp, Artificial Sequence
  Description of Artificial Sequence: example target DNA
gcagctgcgc

SEQ ID NO: 561 - DNA, 10 bp, Artificial Sequence
  Description of Artificial Sequence: example target DNA
tggttggtat

SEQ ID NO: 562 - DNA, 10 bp, Artificial Sequence
  Description of Artificial Sequence: example target DNA
gtgggcttca

SEQ ID NO: 563 - DNA, 10 bp, Artificial Sequence
  Description of Artificial Sequence: example target DNA
ggggcggagc

SEQ ID NO: 564 - DNA, 10 bp, Artificial Sequence
  Description of Artificial Sequence: example target DNA
ggggcggagc

SEQ ID NO: 565 - DNA, 10 bp, Artificial Sequence
  Description of Artificial Sequence: example target DNA
ggcgaggcaa

SEQ ID NO: 566 - DNA, 10 bp, Artificial Sequence
  Description of Artificial Sequence: example target DNA
ggcgaggcaa

SEQ ID NO: 567 - DNA, 10 bp, Artificial Sequence
  Description of Artificial Sequence: example target DNA
gtggcagcgg

SEQ ID NO: 568 - DNA, 10 bp, Artificial Sequence
  Description of Artificial Sequence: example target DNA
gtggcagcgg

SEQ ID NO: 569 - DNA, 10 bp, Artificial Sequence
  Description of Artificial Sequence: example target DNA
gcgggagcag

SEQ ID NO: 570 - DNA, 10 bp, Artificial Sequence
  Description of Artificial Sequence: example target DNA
gcgggagcag

SEQ ID NO: 571 - DNA, 10 bp, Artificial Sequence
  Description of Artificial Sequence: example target DNA
tcagtggtgg

SEQ ID NO: 572 - DNA, 9 bp, Artificial Sequence
  Description of Artificial Sequence: example target DNA
gcggccgca

SEQ ID NO: 573 - DNA, 9 bp, Artificial Sequence
  Description of Artificial Sequence: example target DNA
gcggccgca

SEQ ID NO: 574 - DNA, 9 bp, Artificial Sequence
  Description of Artificial Sequence: example target DNA
gcggccgca

SEQ ID NO: 575 - DNA, 9 bp, Artificial Sequence
  Description of Artificial Sequence: example target DNA
gcggccgca

SEQ ID NO: 576 - DNA, 9 bp, Artificial Sequence
  Description of Artificial Sequence: example target DNA
gcggccgca

SEQ ID NO: 577 - DNA, 9 bp, Artificial Sequence
  Description of Artificial Sequence: example target DNA
gcagaagtc

SEQ ID NO: 578 - DNA, 9 bp, Artificial Sequence
  Description of Artificial Sequence: example target DNA
gcggccgca

SEQ ID NO: 579 - DNA, 9 bp, Artificial Sequence
  Description of Artificial Sequence: example target DNA
gcgtgggcg

SEQ ID NO: 580 - DNA, 9 bp, Artificial Sequence
  Description of Artificial Sequence: example target DNA
gcgtgggca

SEQ ID NO: 581 - DNA, 9 bp, Artificial Sequence
  Description of Artificial Sequence: example target DNA
gcagaagca

SEQ ID NO: 582 - DNA, 9 bp, Artificial Sequence
  Description of Artificial Sequence: example target DNA
gtgtgcgga

SEQ ID NO: 583 - DNA, 9 bp, Artificial Sequence
  Description of Artificial Sequence: example target DNA
tgtgcggcc

SEQ ID NO: 584 - DNA, 10 bp, Artificial Sequence
  Description of Artificial Sequence: example target DNA
ggggtggcgg

SEQ ID NO: 585 - DNA, 10 bp, Artificial Sequence
  Description of Artificial Sequence: example target DNA
gccgaggaga

SEQ ID NO: 586 - DNA, 9 bp, Artificial Sequence
  Description of Artificial Sequence: example target DNA
ggtggtggc

SEQ ID NO: 587 - DNA, 9 bp, Artificial Sequence
  Description of Artificial Sequence: example target DNA
gtttgcgtc

SEQ ID NO: 588 - DNA, 9 bp, Artificial Sequence
  Description of Artificial Sequence: example target DNA
gaagaggca

SEQ ID NO: 589 - DNA, 9 bp, Artificial Sequence
  Description of Artificial Sequence: example target DNA
gcttgtgag

SEQ ID NO: 590 - DNA, 9 bp, Artificial Sequence
  Description of Artificial Sequence: example target DNA
gcttgtgag

SEQ ID NO: 591 - DNA, 9 bp, Artificial Sequence
  Description of Artificial Sequence: example target DNA
gtgggggtt

SEQ ID NO: 592 - DNA, 9 bp, Artificial Sequence
  Description of Artificial Sequence: example target DNA
ggggtggga

SEQ ID NO: 593 - DNA, 10 bp, Artificial Sequence
  Description of Artificial Sequence: example target DNA
gaggtagagg

SEQ ID NO: 594 - DNA, 10 bp, Artificial Sequence
  Description of Artificial Sequence: example target DNA
gaggtagagg

SEQ ID NO: 595 - DNA, 10 bp, Artificial Sequence
  Description of Artificial Sequence: example target DNA
gtcgtgtggc

SEQ ID NO: 596 - DNA, 10 bp, Artificial Sequence
  Description of Artificial Sequence: example target DNA
gttgaggaag

SEQ ID NO: 597 - DNA, 10 bp, Artificial Sequence
  Description of Artificial Sequence: example target DNA
gttgaggaag

SEQ ID NO: 598 - DNA, 10 bp, Artificial Sequence
  Description of Artificial Sequence: example target DNA
gaggtggaag

SEQ ID NO: 599 - DNA, 10 bp, Artificial Sequence
  Description of Artificial Sequence: example target DNA
gaggtggaag

SEQ ID NO: 600 - DNA, 10 bp, Artificial Sequence
  Description of Artificial Sequence: example target DNA
taggtggtgg

SEQ ID NO: 601 - DNA, 10 bp, Artificial Sequence
  Description of Artificial Sequence: example target DNA
tgggaggagt

SEQ ID NO: 602 - DNA, 9 bp, Artificial Sequence
  Description of Artificial Sequence: example target DNA
ggaggagct

SEQ ID NO: 603 - DNA, 10 bp, Artificial Sequence
  Description of Artificial Sequence: example target DNA
ggagctgggg

SEQ ID NO: 604 - DNA, 10 bp, Artificial Sequence
  Description of Artificial Sequence: example target DNA
gggggaggag

SEQ ID NO: 605 - DNA, 10 bp, Artificial Sequence
  Description of Artificial Sequence: example target DNA
ggggaggaga

SEQ ID NO: 606 - DNA, 9 bp, Artificial Sequence
  Description of Artificial Sequence: example target DNA
ggaggagat

SEQ ID NO: 607 - DNA, 9 bp, Artificial Sequence
  Description of Artificial Sequence: example target DNA
gcagcagga

SEQ ID NO: 608 - DNA, 9 bp, Artificial Sequence
  Description of Artificial Sequence: example target DNA
gatgaggca

SEQ ID NO: 609 - DNA, 10 bp, Artificial Sequence
  Description of Artificial Sequence: example target DNA
ggggaggatc

SEQ ID NO: 610 - DNA, 10 bp, Artificial Sequence
  Description of Artificial Sequence: example target DNA
ggggaggatc

SEQ ID NO: 611 - DNA, 10 bp, Artificial Sequence
  Description of Artificial Sequence: example target DNA
gaggcttggg

SEQ ID NO: 612 - DNA, 10 bp, Artificial Sequence
  Description of Artificial Sequence: example target DNA
gcggaggctt

SEQ ID NO: 613 - DNA, 10 bp, Artificial Sequence
  Description of Artificial Sequence: example target DNA
gcggaggctt

SEQ ID NO: 614 - DNA, 10 bp, Artificial Sequence
  Description of Artificial Sequence: example target DNA
gcggaggctt

SEQ ID NO: 615 - DNA, 10 bp, Artificial Sequence
  Description of Artificial Sequence: example target DNA
gcggaggctt

SEQ ID NO: 616 - DNA, 9 bp, Artificial Sequence
  Description of Artificial Sequence: example target DNA
gcagccggg

SEQ ID NO: 617 - DNA, 10 bp, Artificial Sequence
  Description of Artificial Sequence: example target DNA
gcagaggctt

SEQ ID NO: 618 - DNA, 10 bp, Artificial Sequence
  Description of Artificial Sequence: example target DNA
tgggcaggcc

SEQ ID NO: 619 - DNA, 9 bp, Artificial Sequence
  Description of Artificial Sequence: example target DNA
ggggaggat

SEQ ID NO: 620 - DNA, 10 bp, Artificial Sequence
  Description of Artificial Sequence: example target DNA
ggggaaggct

SEQ ID NO: 621 - DNA, 10 bp, Artificial Sequence
  Description of Artificial Sequence: example target DNA
gtgtgtgtgt

SEQ ID NO: 622 - DNA, 10 bp, Artificial Sequence
  Description of Artificial Sequence: example target DNA
gcatacgtgg

SEQ ID NO: 623 - DNA, 9 bp, Artificial Sequence
  Description of Artificial Sequence: example target DNA
gcatacgtg

SEQ ID NO: 624 - DNA, 10 bp, Artificial Sequence
  Description of Artificial Sequence: example target DNA
tacgtggggt

SEQ ID NO: 625 - DNA, 10 bp, Artificial Sequence
  Description of Artificial Sequence: example target DNA
tacgtgggct

SEQ ID NO: 626 - DNA, 10 bp, Artificial Sequence
  Description of Artificial Sequence: example target DNA
gagggtgttg

SEQ ID NO: 627 - DNA, 10 bp, Artificial Sequence
  Description of Artificial Sequence: example target DNA
ggagcgggga

SEQ ID NO: 628 - DNA, 10 bp, Artificial Sequence
  Description of Artificial Sequence: example target DNA
ggggttgagg

SEQ ID NO: 629 - DNA, 10 bp, Artificial Sequence
  Description of Artificial Sequence: example target DNA
ggtgttggag

SEQ ID NO: 630 - DNA, 10 bp, Artificial Sequence
  Description of Artificial Sequence: example target DNA
tacgtgggtt

SEQ ID NO: 631 - DNA, 10 bp, Artificial Sequence
  Description of Artificial Sequence: example target DNA
gtaggggttg

SEQ ID NO: 632 - DNA, 10 bp, Artificial Sequence
  Description of Artificial Sequence: example target DNA
gaaggcggag

SEQ ID NO: 633 - DNA, 10 bp, Artificial Sequence
  Description of Artificial Sequence: example target DNA
gaaggcggag

SEQ ID NO: 634 - DNA, 10 bp, Artificial Sequence
  Description of Artificial Sequence: example target DNA
gggggttacg

SEQ ID NO: 635 - DNA, 10 bp, Artificial Sequence
  Description of Artificial Sequence: example target DNA
gggggggggg

SEQ ID NO: 636 - DNA, 10 bp, Artificial Sequence
  Description of Artificial Sequence: example target DNA
ggagtatgct

SEQ ID NO: 637 - DNA, 10 bp, Artificial Sequence
  Description of Artificial Sequence: example target DNA
tggttggtat

SEQ ID NO: 638 - DNA, 9 bp, Artificial Sequence
  Description of Artificial Sequence: example target DNA
tggttggta

SEQ ID NO: 639 - DNA, 9 bp, Artificial Sequence
  Description of Artificial Sequence: example target DNA
tggttggta

SEQ ID NO: 640 - DNA, 9 bp, Artificial Sequence
  Description of Artificial Sequence: example target DNA
tggttggta

SEQ ID NO: 641 - DNA, 9 bp, Artificial Sequence
  Description of Artificial Sequence: example target DNA
gagtcggaa

SEQ ID NO: 642 - DNA, 9 bp, Artificial Sequence
  Description of Artificial Sequence: example target DNA
gagtcggaa

SEQ ID NO: 643 - DNA, 9 bp, Artificial Sequence
  Description of Artificial Sequence: example target DNA
gagtcggaa

SEQ ID NO: 644 - DNA, 9 bp, Artificial Sequence
  Description of Artificial Sequence: example target DNA
gagtcggaa

SEQ ID NO: 645 - DNA, 10 bp, Artificial Sequence
  Description of Artificial Sequence: example target DNA
ggggaggatc

SEQ ID NO: 646 - protein, 7 aa, Artificial Sequence
  Description of Artificial Sequence: example ZFP
RSDSLTS

SEQ ID NO: 647 - protein, 7 aa, Artificial Sequence
  Description of Artificial Sequence: example ZFP
RSDSLTS

SEQ ID NO: 648 - protein, 7 aa, Artificial Sequence
  Description of Artificial Sequence: example ZFP
RSDSLTS

SEQ ID NO: 649 - protein, 7 aa, Artificial Sequence
  Description of Artificial Sequence: example ZFP
RSDSLTS

SEQ ID NO: 650 - protein, 7 aa, Artificial Sequence
  Description of Artificial Sequence: example ZFP
QSANLAR

SEQ ID NO: 651 - protein, 7 aa, Artificial Sequence
  Description of Artificial Sequence: example ZFP
QSANLAR

SEQ ID NO: 652 - protein, 7 aa, Artificial Sequence
  Description of Artificial Sequence: example ZFP
QRASLAS

SEQ ID NO: 653 - protein, 7 aa, Artificial Sequence
  Description of Artificial Sequence: example ZFP
QRASLAS

SEQ ID NO: 654 - protein, 7 aa, Artificial Sequence
  Description of Artificial Sequence: example ZFP
QSSALAR

SEQ ID NO: 655 - protein, 7 aa, Artificial Sequence
  Description of Artificial Sequence: example ZFP
NRDTLAR

SEQ ID NO: 656 - protein, 7 aa, Artificial Sequence
  Description of Artificial Sequence: example ZFP
QSSALAR

SEQ ID NO: 657 - protein, 7 aa, Artificial Sequence
  Description of Artificial Sequence: example ZFP
NRDTLAR

SEQ ID NO: 658 - protein, 7 aa, Artificial Sequence
  Description of Artificial Sequence: example ZFP
QRAHLAR

SEQ ID NO: 659 - protein, 7 aa, Artificial Sequence
  Description of Artificial Sequence: example ZFP
QRAHLAR

SEQ ID NO: 660 - protein, 7 aa, Artificial Sequence
  Description of Artificial Sequence: example ZFP
NRDHLMV

SEQ ID NO: 661 - protein, 7 aa, Artificial Sequence
  Description of Artificial Sequence: example ZFP
NRDHLTT

SEQ ID NO: 662 - protein, 7 aa, Artificial Sequence
  Description of Artificial Sequence: example ZFP
QRSALAR

SEQ ID NO: 663 - protein, 7 aa, Artificial Sequence
  Description of Artificial Sequence: example ZFP
QQSNLAR

SEQ ID NO: 664 - protein, 7 aa, Artificial Sequence
  Description of Artificial Sequence: example ZFP
QQSNLAR

SEQ ID NO: 665 - protein, 7 aa, Artificial Sequence
  Description of Artificial Sequence: example ZFP
DRSNLRT

SEQ ID NO: 666 - protein, 7 aa, Artificial Sequence
  Description of Artificial Sequence: example ZFP
ERSNLRT

SEQ ID NO: 667 - protein, 7 aa, Artificial Sequence
  Description of Artificial Sequence: example ZFP
DRSNLRT

SEQ ID NO: 668 - protein, 7 aa, Artificial Sequence
  Description of Artificial Sequence: example ZFP
ERSNLRT

SEQ ID NO: 669 - protein, 7 aa, Artificial Sequence
  Description of Artificial Sequence: example ZFP
DRSALAR

SEQ ID NO: 670 - protein, 7 aa, Artificial Sequence
  Description of Artificial Sequence: example ZFP
RGDALTS

SEQ ID NO: 671 - protein, 7 aa, Artificial Sequence
  Description of Artificial Sequence: example ZFP
RGDALTV

SEQ ID NO: 672 - protein, 7 aa, Artificial Sequence
  Description of Artificial Sequence: example ZFP
RGDALTM

SEQ ID NO: 673 - protein, 7 aa, Artificial Sequence
  Description of Artificial Sequence: example ZFP
RGDALTS

SEQ ID NO: 674 - protein, 7 aa, Artificial Sequence
  Description of Artificial Sequence: example ZFP
RGDALTV

SEQ ID NO: 675 - protein, 7 aa, Artificial Sequence
  Description of Artificial Sequence: example ZFP
RGDALTM

SEQ ID NO: 676 - protein, 7 aa, Artificial Sequence
  Description of Artificial Sequence: example ZFP
RSDALTR

SEQ ID NO: 677 - protein, 7 aa, Artificial Sequence
  Description of Artificial Sequence: example ZFP
RSDALTR

SEQ ID NO: 678 - protein, 7 aa, Artificial Sequence
  Description of Artificial Sequence: example ZFP
RSDALTR

SEQ ID NO: 679 - protein, 7 aa, Artificial Sequence
  Description of Artificial Sequence: example ZFP
RSDHLAR

SEQ ID NO: 680 - protein, 7 aa, Artificial Sequence
  Description of Artificial Sequence: example ZFP
ERGTLAR

SEQ ID NO: 681 - protein, 7 aa, Artificial Sequence
  Description of Artificial Sequence: example ZFP
ERGTLAR

SEQ ID NO: 682 - protein, 7 aa, Artificial Sequence
  Description of Artificial Sequence: example ZFP
RSDNLTR

SEQ ID NO: 683 - protein, 7 aa, Artificial Sequence
  Description of Artificial Sequence: example ZFP
RSDNLTR

SEQ ID NO: 684 - protein, 7 aa, Artificial Sequence
  Description of Artificial Sequence: example ZFP
QSSDLRR

SEQ ID NO: 685 - protein, 7 aa, Artificial Sequence
  Description of Artificial Sequence: example ZFP
QSSDLRR

SEQ ID NO: 686 - protein, 7 aa, Artificial Sequence
  Description of Artificial Sequence: example ZFP
RSDHLAR

SEQ ID NO: 687 - protein, 7 aa, Artificial Sequence
  Description of Artificial Sequence: example ZFP
RSDHLAR

SEQ ID NO: 688 - protein, 7 aa, Artificial Sequence
  Description of Artificial Sequence: example ZFP
RSDNLAR

SEQ ID NO: 689 - protein, 7 aa, Artificial Sequence
  Description of Artificial Sequence: example ZFP
RSDNLAR

SEQ ID NO: 690 - protein, 7 aa, Artificial Sequence
  Description of Artificial Sequence: example ZFP
RSDELTR

SEQ ID NO: 691 - protein, 7 aa, Artificial Sequence
  Description of Artificial Sequence: example ZFP
RSDELTR

SEQ ID NO: 692 - protein, 7 aa, Artificial Sequence
  Description of Artificial Sequence: example ZFP
QSWELTR

SEQ ID NO: 693 - protein, 7 aa, Artificial Sequence
  Description of Artificial Sequence: example ZFP
QSWELTR

SEQ ID NO: 694 - protein, 7 aa, Artificial Sequence
  Description of Artificial Sequence: example ZFP
QSGSLTR

SEQ ID NO: 695 - protein, 7 aa, Artificial Sequence
  Description of Artificial Sequence: example ZFP
QSGSLTR

SEQ ID NO: 696 - protein, 7 aa, Artificial Sequence
  Description of Artificial Sequence: example ZFP
RGDALTR

SEQ ID NO: 697 - protein, 7 aa, Artificial Sequence
  Description of Artificial Sequence: example ZFP
RSDALTR

SEQ ID NO: 698 - protein, 7 aa, Artificial Sequence
  Description of Artificial Sequence: example ZFP
QSGSLTR

SEQ ID NO: 699 - protein, 7 aa, Artificial Sequence
  Description of Artificial Sequence: example ZFP
ERGTLAR

SEQ ID NO: 700 - protein, 7 aa, Artificial Sequence
  Description of Artificial Sequence: example ZFP
RGPDLAR

SEQ ID NO: 701 - protein, 7 aa, Artificial Sequence
  Description of Artificial Sequence: example ZFP
RGPDLAR

SEQ ID NO: 702 - protein, 7 aa, Artificial Sequence
  Description of Artificial Sequence: example ZFP
RGPDLAR

SEQ ID NO: 703 - protein, 7 aa, Artificial Sequence
  Description of Artificial Sequence: example ZFP
RSDELAR

SEQ ID NO: 704 - protein, 7 aa, Artificial Sequence
  Description of Artificial Sequence: example ZFP
RSDELTR

SEQ ID NO: 705 - protein, 7 aa, Artificial Sequence
  Description of Artificial Sequence: example ZFP
DRSHLTR

SEQ ID NO: 706 - protein, 7 aa, Artificial Sequence
  Description of Artificial Sequence: example ZFP
ERGTLAR

SEQ ID NO: 707 - protein, 7 aa, Artificial Sequence
  Description of Artificial Sequence: example ZFP
ERGTLAR

SEQ ID NO: 708 - protein, 7 aa, Artificial Sequence
  Description of Artificial Sequence: example ZFP
QTGELRR

SEQ ID NO: 709 - protein, 7 aa, Artificial Sequence
  Description of Artificial Sequence: example ZFP
QTSDLRR

SEQ ID NO: 710 - protein, 7 aa, Artificial Sequence
  Description of Artificial Sequence: example ZFP
QTADLRR

SEQ ID NO: 711 - protein, 7 aa, Artificial Sequence
  Description of Artificial Sequence: example ZFP
QSADLRR

SEQ ID NO: 712 - protein, 7 aa, Artificial Sequence
  Description of Artificial Sequence: example ZFP
QSGSLTR

SEQ ID NO: 713 - protein, 7 aa, Artificial Sequence
  Description of Artificial Sequence: example ZFP
QTGSLTR

SEQ ID NO: 714 - protein, 7 aa, Artificial Sequence
  Description of Artificial Sequence: example ZFP
QTADLTR

SEQ ID NO: 715 - protein, 7 aa, Artificial Sequence
  Description of Artificial Sequence: example ZFP
QTGDLTR

SEQ ID NO: 716 - protein, 7 aa, Artificial Sequence
  Description of Artificial Sequence: example ZFP
QTASLTR

SEQ ID NO: 717 - protein, 7 aa, Artificial Sequence
  Description of Artificial Sequence: example ZFP
RSDELRR

SEQ ID NO: 718 - protein, 7 aa, Artificial Sequence
  Description of Artificial Sequence: example ZFP
RSDELRR

SEQ ID NO: 719 - protein, 7 aa, Artificial Sequence
  Description of Artificial Sequence: example ZFP
ERSDLRR

SEQ ID NO: 720 - protein, 7 aa, Artificial Sequence
  Description of Artificial Sequence: example ZFP
DRSDLTR

SEQ ID NO: 721 - protein, 7 aa, Artificial Sequence
  Description of Artificial Sequence: example ZFP
DRSTLTR

SEQ ID NO: 722 - protein, 7 aa, Artificial Sequence
  Description of Artificial Sequence: example ZFP
ERGTLAR

SEQ ID NO: 723 - protein, 7 aa, Artificial Sequence
  Description of Artificial Sequence: example ZFP
DRSDLTR

SEQ ID NO: 724 - protein, 7 aa, Artificial Sequence
  Description of Artificial Sequence: example ZFP
DRSSLTR

SEQ ID NO: 725 - protein, 7 aa, Artificial Sequence
  Description of Artificial Sequence: example ZFP
ERGTLAR

SEQ ID NO: 726 - protein, 7 aa, Artificial Sequence
  Description of Artificial Sequence: example ZFP
ERGTLAR

SEQ ID NO: 727 - protein, 7 aa, Artificial Sequence
  Description of Artificial Sequence: example ZFP
RSDALTS

SEQ ID NO: 728 - protein, 7 aa, Artificial Sequence
  Description of Artificial Sequence: example ZFP
KTSHLRA

SEQ ID NO: 729 - protein, 7 aa, Artificial Sequence
  Description of Artificial Sequence: example ZFP
RSDHLTR

SEQ ID NO: 730 - protein, 7 aa, Artificial Sequence
  Description of Artificial Sequence: example ZFP
TTSNLRR

SEQ ID NO: 731 - protein, 7 aa, Artificial Sequence
  Description of Artificial Sequence: example ZFP
TTSNLRR

SEQ ID NO: 732 - protein, 7 aa, Artificial Sequence
  Description of Artificial Sequence: example ZFP
TTSNLRR

SEQ ID NO: 733 - protein, 7 aa, Artificial Sequence
  Description of Artificial Sequence: example ZFP
NSSDLTR

SEQ ID NO: 734 - protein, 7 aa, Artificial Sequence
  Description of Artificial Sequence: example ZFP
NSDALTR

SEQ ID NO: 735 - protein, 7 aa, Artificial Sequence
  Description of Artificial Sequence: example ZFP
RSDHLTR

SEQ ID NO: 736 - protein, 7 aa, Artificial Sequence
  Description of Artificial Sequence: example ZFP
RSDHLTR

SEQ ID NO: 737 - protein, 7 aa, Artificial Sequence
  Description of Artificial Sequence: example ZFP
DCRDLAR

SEQ ID NO: 738 - protein, 7 aa, Artificial Sequence
  Description of Artificial Sequence: example ZFP
TSGHLTR

SEQ ID NO: 739 - protein, 7 aa, Artificial Sequence
  Description of Artificial Sequence: example ZFP
DSGSLTR

SEQ ID NO: 740 - protein, 7 aa, Artificial Sequence
  Description of Artificial Sequence: example ZFP
RSDSLLR

SEQ ID NO: 741 - protein, 7 aa, Artificial Sequence
  Description of Artificial Sequence: example ZFP
DCRDLAR

SEQ ID NO: 742 - protein, 7 aa, Artificial Sequence
  Description of Artificial Sequence: example ZFP
DSSNLTR

SEQ ID NO: 743 - protein, 7 aa, Artificial Sequence
  Description of Artificial Sequence: example ZFP
EKANLTR

SEQ ID NO: 744 - protein, 7 aa, Artificial Sequence
  Description of Artificial Sequence: example ZFP
RSDELRR

SEQ ID NO: 745 - protein, 7 aa, Artificial Sequence
  Description of Artificial Sequence: example ZFP
RSDELRR

SEQ ID NO: 746 - protein, 7 aa, Artificial Sequence
  Description of Artificial Sequence: example ZFP
RSDELRR

SEQ ID NO: 747 - protein, 7 aa, Artificial Sequence
  Description of Artificial Sequence: example ZFP
RSDHLTR

SEQ ID NO: 748 - protein, 7 aa, Artificial Sequence
  Description of Artificial Sequence: example ZFP
RSDHLTR

SEQ ID NO: 749 - protein, 7 aa, Artificial Sequence
  Description of Artificial Sequence: example ZFP
RSDNLTR

SEQ ID NO: 750 - protein, 7 aa, Artificial Sequence
  Description of Artificial Sequence: example ZFP
QASHLTR

SEQ ID NO: 751 - protein, 7 aa, Artificial Sequence
  Description of Artificial Sequence: example ZFP
QASVLTR

SEQ ID NO: 752 - protein, 7 aa, Artificial Sequence
  Description of Artificial Sequence: example ZFP
RSDHLTR

SEQ ID NO: 753 - protein, 7 aa, Artificial Sequence
  Description of Artificial Sequence: example ZFP
RSDELTR

SEQ ID NO: 754 - protein, 7 aa, Artificial Sequence
  Description of Artificial Sequence: example ZFP
RSDALTR

SEQ ID NO: 755 - protein, 7 aa, Artificial Sequence
  Description of Artificial Sequence: example ZFP
RSDALTR

SEQ ID NO: 756 - protein, 7 aa, Artificial Sequence
  Description of Artificial Sequence: example ZFP
RSDALTR

SEQ ID NO: 757 - protein, 7 aa, Artificial Sequence
  Description of Artificial Sequence: example ZFP
RSDSLLR

SEQ ID NO: 758 - protein, 7 aa, Artificial Sequence
  Description of Artificial Sequence: example ZFP
RSDSLLR

SEQ ID NO: 759 - protein, 7 aa, Artificial Sequence
  Description of Artificial Sequence: example ZFP
QRSNLVR

SEQ ID NO: 760 - protein, 7 aa, Artificial Sequence
  Description of Artificial Sequence: example ZFP
QQSNLAR

SEQ ID NO: 761 - protein, 7 aa, Artificial Sequence
  Description of Artificial Sequence: example ZFP
QSGSLTR

SEQ ID NO: 762 - protein, 7 aa, Artificial Sequence
  Description of Artificial Sequence: example ZFP
RSDNLTR

SEQ ID NO: 763 - protein, 7 aa, Artificial Sequence
  Description of Artificial Sequence: example ZFP
RSDNLTR

SEQ ID NO: 764 - protein, 7 aa, Artificial Sequence
  Description of Artificial Sequence: example ZFP
QSANLAR

SEQ ID NO: 765 - protein, 7 aa, Artificial Sequence
  Description of Artificial Sequence: example ZFP
RSDELTR

SEQ ID NO: 766 - protein, 7 aa, Artificial Sequence
  Description of Artificial Sequence: example ZFP
QSATLAR

SEQ ID NO: 767 - protein, 7 aa, Artificial Sequence
  Description of Artificial Sequence: example ZFP
DRSALTT

SEQ ID NO: 768 - protein, 7 aa, Artificial Sequence
  Description of Artificial Sequence: example ZFP
RSDNLTR

SEQ ID NO: 769 - protein, 7 aa, Artificial Sequence
  Description of Artificial Sequence: example ZFP
RSDNLTR

SEQ ID NO: 770 - protein, 7 aa, Artificial Sequence
  Description of Artificial Sequence: example ZFP
QSGSLTR

SEQ ID NO: 771 - protein, 7 aa, Artificial Sequence
  Description of Artificial Sequence: example ZFP
QSGDLTR

SEQ ID NO: 772 - protein, 7 aa, Artificial Sequence
  Description of Artificial Sequence: example ZFP
RSDTLKK

SEQ ID NO: 773 - protein, 7 aa, Artificial Sequence
  Description of Artificial Sequence: example ZFP
RSDELTR

SEQ ID NO: 774 - protein, 7 aa, Artificial Sequence
  Description of Artificial Sequence: example ZFP
QSGSLTR

SEQ ID NO: 775 - protein, 7 aa, Artificial Sequence
  Description of Artificial Sequence: example ZFP
QSGDLTR

SEQ ID NO: 776 - protein, 7 aa, Artificial Sequence
  Description of Artificial Sequence: example ZFP
RSDALAR

SEQ ID NO: 777 - protein, 7 aa, Artificial Sequence
  Description of Artificial Sequence: example ZFP
RSDELTR

SEQ ID NO: 778 - protein, 7 aa, Artificial Sequence
  Description of Artificial Sequence: example ZFP
RSDELTR

SEQ ID NO: 779 - protein, 7 aa, Artificial Sequence
  Description of Artificial Sequence: example ZFP
QSWELTR

SEQ ID NO: 780 - protein, 7 aa, Artificial Sequence
  Description of Artificial Sequence: example ZFP
QSWELTR

SEQ ID NO: 781 - protein, 7 aa, Artificial Sequence
  Description of Artificial Sequence: example ZFP
QSGSLTR

SEQ ID NO: 782 - protein, 7 aa, Artificial Sequence
  Description of Artificial Sequence: example ZFP
RSDALTR

SEQ ID NO: 783 - protein, 7 aa, Artificial Sequence
  Description of Artificial Sequence: example ZFP
QSGSLTR

SEQ ID NO: 784 - protein, 7 aa, Artificial Sequence
  Description of Artificial Sequence: example ZFP
QSGSLTR

SEQ ID NO: 785 - protein, 7 aa, Artificial Sequence
  Description of Artificial Sequence: example ZFP
QSGSLTR

SEQ ID NO: 786 - protein, 7 aa, Artificial Sequence
  Description of Artificial Sequence: example ZFP
RSDELTR

SEQ ID NO: 787 - protein, 7 aa, Artificial Sequence
  Description of Artificial Sequence: example ZFP
DRSHLTR

SEQ ID NO: 788 - protein, 7 aa, Artificial Sequence
  Description of Artificial Sequence: example ZFP
ERGTLAR

SEQ ID NO: 789 - protein, 7 aa, Artificial Sequence
  Description of Artificial Sequence: example ZFP
RSDTLKK

SEQ ID NO: 790 - protein, 7 aa, Artificial Sequence
  Description of Artificial Sequence: example ZFP
RSDNLTR

SEQ ID NO: 791 - protein, 7 aa, Artificial Sequence
  Description of Artificial Sequence: example ZFP
DTSHLRR

SEQ ID NO: 792 - protein, 7 aa, Artificial Sequence
  Description of Artificial Sequence: example ZFP
ETASLRR

SEQ ID NO: 793 - protein, 7 aa, Artificial Sequence
  Description of Artificial Sequence: example ZFP
QTGELRR

SEQ ID NO: 794 - protein, 7 aa, Artificial Sequence
  Description of Artificial Sequence: example ZFP
RTSNLRR

SEQ ID NO: 795 - protein, 7 aa, Artificial Sequence
  Description of Artificial Sequence: example ZFP
RSDNLTR

SEQ ID NO: 796 - protein, 7 aa, Artificial Sequence
  Description of Artificial Sequence: example ZFP
NRATLAR

SEQ ID NO: 797 - protein, 7 aa, Artificial Sequence
  Description of Artificial Sequence: example ZFP
QSAHLAR

SEQ ID NO: 798 - protein, 7 aa, Artificial Sequence
  Description of Artificial Sequence: example ZFP
RSDNLAR

SEQ ID NO: 799 - protein, 7 aa, Artificial Sequence
  Description of Artificial Sequence: example ZFP
RSDNLAR

SEQ ID NO: 800 - protein, 7 aa, Artificial Sequence
  Description of Artificial Sequence: example ZFP
RSDHLTT

SEQ ID NO: 801 - protein, 7 aa, Artificial Sequence
  Description of Artificial Sequence: example ZFP
QSGNLAR

SEQ ID NO: 802 - protein, 7 aa, Artificial Sequence
  Description of Artificial Sequence: example ZFP
QSGNLAR

SEQ ID NO: 803 - protein, 7 aa, Artificial Sequence
  Description of Artificial Sequence: example ZFP
QSGNLAR

SEQ ID NO: 804 - protein, 7 aa, Artificial Sequence
  Description of Artificial Sequence: example ZFP
QSANLAR

SEQ ID NO: 805 - protein, 7 aa, Artificial Sequence
  Description of Artificial Sequence: example ZFP
RSDALTR

SEQ ID NO: 806 - protein, 7 aa, Artificial Sequence
  Description of Artificial Sequence: example ZFP
RSDNLTR

SEQ ID NO: 807 - protein, 7 aa, Artificial Sequence
  Description of Artificial Sequence: example ZFP
TTSELRR

SEQ ID NO: 808 - protein, 7 aa, Artificial Sequence
  Description of Artificial Sequence: example ZFP
RTDHLRR

SEQ ID NO: 809 - protein, 7 aa, Artificial Sequence
  Description of Artificial Sequence: example ZFP
QTGHLRR

SEQ ID NO: 810 - protein, 7 aa, Artificial Sequence
  Description of Artificial Sequence: example ZFP
RSDNLAR

SEQ ID NO: 811 - protein, 7 aa, Artificial Sequence
  Description of Artificial Sequence: example ZFP
TTANLRR

SEQ ID NO: 812 - protein, 7 aa, Artificial Sequence
  Description of Artificial Sequence: example ZFP
QTGHLRR

SEQ ID NO: 813 - protein, 7 aa, Artificial Sequence
  Description of Artificial Sequence: example ZFP
QTGELRR

SEQ ID NO: 814 - protein, 7 aa, Artificial Sequence
  Description of Artificial Sequence: example ZFP
TTSNLRR

SEQ ID NO: 815 - protein, 7 aa, Artificial Sequence
  Description of Artificial Sequence: example ZFP
TTSNLRR

SEQ ID NO: 816 - protein, 7 aa, Artificial Sequence
  Description of Artificial Sequence: example ZFP
RTDHLRK

SEQ ID NO: 817 - protein, 7 aa, Artificial Sequence
  Description of Artificial Sequence: example ZFP
TTGELRR

SEQ ID NO: 818 - protein, 7 aa, Artificial Sequence
  Description of Artificial Sequence: example ZFP
QSSDLQR

SEQ ID NO: 819 - protein, 7 aa, Artificial Sequence
  Description of Artificial Sequence: example ZFP
QSSDLQR

SEQ ID NO: 820 - protein, 7 aa, Artificial Sequence
  Description of Artificial Sequence: example ZFP
QSSDLQR

SEQ ID NO: 821 - protein, 7 aa, Artificial Sequence
  Description of Artificial Sequence: example ZFP
RTDHLRR

SEQ ID NO: 822 - protein, 7 aa, Artificial Sequence
  Description of Artificial Sequence: example ZFP
QSSDLQR

SEQ ID NO: 823 - protein, 7 aa, Artificial Sequence
  Description of Artificial Sequence: example ZFP
DRSHLTR

SEQ ID NO: 824 - protein, 7 aa, Artificial Sequence
  Description of Artificial Sequence: example ZFP
TTSNLRR

SEQ ID NO: 825 - protein, 7 aa, Artificial Sequence
  Description of Artificial Sequence: example ZFP
DSGHLTR

SEQ ID NO: 826 - protein, 7 aa, Artificial Sequence
  Description of Artificial Sequence: example ZFP
RSDSLTR

SEQ ID NO: 827 - protein, 7 aa, Artificial Sequence
  Description of Artificial Sequence: example ZFP
RSDSLLR

SEQ ID NO: 828 - protein, 7 aa, Artificial Sequence
  Description of Artificial Sequence: example ZFP
RSDSLLR

SEQ ID NO: 829 - protein, 7 aa, Artificial Sequence
  Description of Artificial Sequence: example ZFP
RSDHLTR

SEQ ID NO: 830 - protein, 7 aa, Artificial Sequence
  Description of Artificial Sequence: example ZFP
DFSHLTR

SEQ ID NO: 831 - protein, 7 aa, Artificial Sequence
  Description of Artificial Sequence: example ZFP
NSDTLAR

SEQ ID NO: 832 - protein, 7 aa, Artificial Sequence
  Description of Artificial Sequence: example ZFP
RSDHLSR

SEQ ID NO: 833 - protein, 7 aa, Artificial Sequence
  Description of Artificial Sequence: example ZFP
RSDNLTR

SEQ ID NO: 834 - protein, 7 aa, Artificial Sequence
  Description of Artificial Sequence: example ZFP
QRAHLAR

SEQ ID NO: 835 - protein, 7 aa, Artificial Sequence
  Description of Artificial Sequence: example ZFP
QSSHLTR

SEQ ID NO: 836 - protein, 7 aa, Artificial Sequence
  Description of Artificial Sequence: example ZFP
NSSALTR

SEQ ID NO: 837 - protein, 7 aa, Artificial Sequence
  Description of Artificial Sequence: example ZFP
QAGHLTR

SEQ ID NO: 838 - protein, 7 aa, Artificial Sequence
  Description of Artificial Sequence: example ZFP
QAGHLTR

SEQ ID NO: 839 - protein, 7 aa, Artificial Sequence
  Description of Artificial Sequence: example ZFP
DKGNLQT

SEQ ID NO: 840 - protein, 7 aa, Artificial Sequence
  Description of Artificial Sequence: example ZFP
RSDHLSR

SEQ ID NO: 841 - protein, 7 aa, Artificial Sequence
  Description of Artificial Sequence: example ZFP
DSGHLAS

SEQ ID NO: 842 - protein, 7 aa, Artificial Sequence
  Description of Artificial Sequence: example ZFP
QRGSLAR

SEQ ID NO: 843 - protein, 7 aa, Artificial Sequence
  Description of Artificial Sequence: example ZFP
QNSAMRK

SEQ ID NO: 844 - protein, 7 aa, Artificial Sequence
  Description of Artificial Sequence: example ZFP
QRGSLAR

SEQ ID NO: 845 - protein, 7 aa, Artificial Sequence
  Description of Artificial Sequence: example ZFP
QNSAMRK

SEQ ID NO: 846 - protein, 7 aa, Artificial Sequence
  Description of Artificial Sequence: example ZFP
QSANLAR

SEQ ID NO: 847 - protein, 7 aa, Artificial Sequence
  Description of Artificial Sequence: example ZFP
RSANLTR

SEQ ID NO: 848 - protein, 7 aa, Artificial Sequence
  Description of Artificial Sequence: example ZFP
RSANLTR

SEQ ID NO: 849 - protein, 7 aa, Artificial Sequence
  Description of Artificial Sequence: example ZFP
QSGNLAR

SEQ ID NO: 850 - protein, 7 aa, Artificial Sequence
  Description of Artificial Sequence: example ZFP
TTSNLRR

SEQ ID NO: 851 - protein, 7 aa, Artificial Sequence
  Description of Artificial Sequence: example ZFP
ERSTLTR

SEQ ID NO: 852 - protein, 7 aa, Artificial Sequence
  Description of Artificial Sequence: example ZFP
ERSTLTR

SEQ ID NO: 853 - protein, 7 aa, Artificial Sequence
  Description of Artificial Sequence: example ZFP
ERSTLTR

SEQ ID NO: 854 - protein, 7 aa, Artificial Sequence
  Description of Artificial Sequence: example ZFP
ERSTLTR

SEQ ID NO: 855 - protein, 7 aa, Artificial Sequence
  Description of Artificial Sequence: example ZFP
QSATLAR

SEQ ID NO: 856 - protein, 7 aa, Artificial Sequence
  Description of Artificial Sequence: example ZFP
QSAVLAR

SEQ ID NO: 857 - protein, 7 aa, Artificial Sequence
  Description of Artificial Sequence: example ZFP
RSDHLTT

SEQ ID NO: 858 - protein, 7 aa, Artificial Sequence
  Description of Artificial Sequence: example ZFP
DRSALAR

SEQ ID NO: 859 - protein, 7 aa, Artificial Sequence
  Description of Artificial Sequence: example ZFP
RSDALAR

SEQ ID NO: 860 - protein, 7 aa, Artificial Sequence
  Description of Artificial Sequence: example ZFP
RSDALAR

SEQ ID NO: 861 - protein, 7 aa, Artificial Sequence
  Description of Artificial Sequence: example ZFP
RSDALAS

SEQ ID NO: 862 - protein, 7 aa, Artificial Sequence
  Description of Artificial Sequence: example ZFP
RSDALAS

SEQ ID NO: 863 - protein, 7 aa, Artificial Sequence
  Description of Artificial Sequence: example ZFP
QSSTLAR

SEQ ID NO: 864 - protein, 7 aa, Artificial Sequence
  Description of Artificial Sequence: example ZFP
QSSTLAR

SEQ ID NO: 865 - protein, 7 aa, Artificial Sequence
  Description of Artificial Sequence: example ZFP
DRSALAR

SEQ ID NO: 866 - protein, 7 aa, Artificial Sequence
  Description of Artificial Sequence: example ZFP
DRSALAR

SEQ ID NO: 867 - protein, 7 aa, Artificial Sequence
  Description of Artificial Sequence: example ZFP
DRSALAR

SEQ ID NO: 868 - protein, 7 aa, Artificial Sequence
  Description of Artificial Sequence: example ZFP
NRDTLAR

SEQ ID NO: 869 - protein, 7 aa, Artificial Sequence
  Description of Artificial Sequence: example ZFP
NRDTLAR

SEQ ID NO: 870 - protein, 7 aa, Artificial Sequence
  Description of Artificial Sequence: example ZFP
RSDNLAR

SEQ ID NO: 871 - protein, 7 aa, Artificial Sequence
  Description of Artificial Sequence: example ZFP
RSDNLAR

SEQ ID NO: 872 - protein, 7 aa, Artificial Sequence
  Description of Artificial Sequence: example ZFP
RSDNLAR

SEQ ID NO: 873 - protein, 7 aa, Artificial Sequence
  Description of Artificial Sequence: example ZFP
RSDNLAR

SEQ ID NO: 874 - protein, 7 aa, Artificial Sequence
  Description of Artificial Sequence: example ZFP
RSDNLAR

SEQ ID NO: 875 - protein, 7 aa, Artificial Sequence
  Description of Artificial Sequence: example ZFP
ERGTLAR

SEQ ID NO: 876 - protein, 7 aa, Artificial Sequence
  Description of Artificial Sequence: example ZFP
ERGTLAR

SEQ ID NO: 877 - protein, 7 aa, Artificial Sequence
  Description of Artificial Sequence: example ZFP
ERGTLAR

SEQ ID NO: 878 - protein, 7 aa, Artificial Sequence
  Description of Artificial Sequence: example ZFP
ERGTLAR

SEQ ID NO: 879 - protein, 7 aa, Artificial Sequence
  Description of Artificial Sequence: example ZFP
ERGTLAR

SEQ ID NO: 880 - protein, 7 aa, Artificial Sequence
  Description of Artificial Sequence: example ZFP
ERGTLAR

SEQ ID NO: 881 - protein, 7 aa, Artificial Sequence
  Description of Artificial Sequence: example ZFP
RSDALAR

SEQ ID NO: 882 - protein, 7 aa, Artificial Sequence
  Description of Artificial Sequence: example ZFP
RSDALAR

SEQ ID NO: 883 - protein, 7 aa, Artificial Sequence
  Description of Artificial Sequence: example ZFP
RSDNLAR

SEQ ID NO: 884 - protein, 7 aa, Artificial Sequence
  Description of Artificial Sequence: example ZFP
RSDNLAR

SEQ ID NO: 885 - protein, 7 aa, Artificial Sequence
  Description of Artificial Sequence: example ZFP
RSDNLAR

SEQ ID NO: 886 - protein, 7 aa, Artificial Sequence
  Description of Artificial Sequence: example ZFP
RSDNLQR

SEQ ID NO: 887 - protein, 7 aa, Artificial Sequence
  Description of Artificial Sequence: example ZFP
RSDHLTR

SEQ ID NO: 888 - protein, 7 aa, Artificial Sequence
  Description of Artificial Sequence: example ZFP
RSDHLSR

SEQ ID NO: 889 - protein, 7 aa, Artificial Sequence
  Description of Artificial Sequence: example ZFP
QSSHLAR

SEQ ID NO: 890 - protein, 7 aa, Artificial Sequence
  Description of Artificial Sequence: example ZFP
DRSHLAR

SEQ ID NO: 891 - protein, 7 aa, Artificial Sequence
  Description of Artificial Sequence: example ZFP
QSGNLTR

SEQ ID NO: 892 - protein, 7 aa, Artificial Sequence
  Description of Artificial Sequence: example ZFP
QSANLTR

SEQ ID NO: 893 - protein, 7 aa, Artificial Sequence
  Description of Artificial Sequence: example ZFP
RSDHLAR

SEQ ID NO: 894 - protein, 7 aa, Artificial Sequence
  Description of Artificial Sequence: example ZFP
RSDHLAR

SEQ ID NO: 895 - protein, 7 aa, Artificial Sequence
  Description of Artificial Sequence: example ZFP
ERGTLAR

SEQ ID NO: 896 - protein, 7 aa, Artificial Sequence
  Description of Artificial Sequence: example ZFP
DRSSLTR

SEQ ID NO: 897 - protein, 7 aa, Artificial Sequence
  Description of Artificial Sequence: example ZFP
ERGTLAR

SEQ ID NO: 898 - protein, 7 aa, Artificial Sequence
  Description of Artificial Sequence: example ZFP
DRSSLTR

SEQ ID NO: 899 - protein, 7 aa, Artificial Sequence
  Description of Artificial Sequence: example ZFP
ERGTLAR

SEQ ID NO: 900 - protein, 7 aa, Artificial Sequence
  Description of Artificial Sequence: example ZFP
DRSSLTR

SEQ ID NO: 901 - protein, 7 aa, Artificial Sequence
  Description of Artificial Sequence: example ZFP
QSANLTR

SEQ ID NO: 902 - protein, 7 aa, Artificial Sequence
  Description of Artificial Sequence: example ZFP
QSGNLTR

SEQ ID NO: 903 - protein, 7 aa, Artificial Sequence
  Description of Artificial Sequence: example ZFP
RSDHLTT

SEQ ID NO: 904 - protein, 7 aa, Artificial Sequence
  Description of Artificial Sequence: example ZFP
RSDELTR

SEQ ID NO: 905 - protein, 7 aa, Artificial Sequence
  Description of Artificial Sequence: example ZFP
QSANLTR

SEQ ID NO: 906 - protein, 7 aa, Artificial Sequence
  Description of Artificial Sequence: example ZFP
QSANLTR

SEQ ID NO: 907 - protein, 7 aa, Artificial Sequence
  Description of Artificial Sequence: example ZFP
QSGNLQR

SEQ ID NO: 908 - protein, 7 aa, Artificial Sequence
  Description of Artificial Sequence: example ZFP
QSANLQR

SEQ ID NO: 909 - protein, 7 aa, Artificial Sequence
  Description of Artificial Sequence: example ZFP
QSANLQR

SEQ ID NO: 910 - protein, 7 aa, Artificial Sequence
  Description of Artificial Sequence: example ZFP
ERHSLQT

SEQ ID NO: 911 - protein, 7 aa, Artificial Sequence
  Description of Artificial Sequence: example ZFP
RSDELTR

SEQ ID NO: 912 - protein, 7 aa, Artificial Sequence
  Description of Artificial Sequence: example ZFP
RSDELRR

SEQ ID NO: 913 - protein, 7 aa, Artificial Sequence
  Description of Artificial Sequence: example ZFP
RSDNLQK

SEQ ID NO: 914 - protein, 7 aa, Artificial Sequence
  Description of Artificial Sequence: example ZFP
RSDNLQK

SEQ ID NO: 915 - protein, 7 aa, Artificial Sequence
  Description of Artificial Sequence: example ZFP
RSDNLQR

SEQ ID NO: 916 - protein, 7 aa, Artificial Sequence
  Description of Artificial Sequence: example ZFP
RSDNLQT

SEQ ID NO: 917 - protein, 7 aa, Artificial Sequence
  Description of Artificial Sequence: example ZFP
RSDNLQT

SEQ ID NO: 918 - protein, 7 aa, Artificial Sequence
  Description of Artificial Sequence: example ZFP
RSDNLQT

SEQ ID NO: 919 - protein, 7 aa, Artificial Sequence
  Description of Artificial Sequence: example ZFP
RSDNLQT

SEQ ID NO: 920 - protein, 7 aa, Artificial Sequence
  Description of Artificial Sequence: example ZFP
RSDNLQT

SEQ ID NO: 921 - protein, 7 aa, Artificial Sequence
  Description of Artificial Sequence: example ZFP
RSDNLQT

SEQ ID NO: 922 - protein, 7 aa, Artificial Sequence
  Description of Artificial Sequence: example ZFP
QSGNLQR

SEQ ID NO: 923 - protein, 7 aa, Artificial Sequence
  Description of Artificial Sequence: example ZFP
QSANLQR

SEQ ID NO: 924 - protein, 7 aa, Artificial Sequence
  Description of Artificial Sequence: example ZFP
QSSNLQR

SEQ ID NO: 925 - protein, 7 aa, Artificial Sequence
  Description of Artificial Sequence: example ZFP
NRDNLQT

SEQ ID NO: 926 - protein, 7 aa, Artificial Sequence
  Description of Artificial Sequence: example ZFP
NRDNLQR

SEQ ID NO: 927 - protein, 7 aa, Artificial Sequence
  Description of Artificial Sequence: example ZFP
NRDNLQR

SEQ ID NO: 928 - protein, 7 aa, Artificial Sequence
  Description of Artificial Sequence: example ZFP
QRSNLQR

SEQ ID NO: 929 - protein, 7 aa, Artificial Sequence
  Description of Artificial Sequence: example ZFP
QSSNLQR

SEQ ID NO: 930 - protein, 7 aa, Artificial Sequence
  Description of Artificial Sequence: example ZFP
QSSNLQR

SEQ ID NO: 931 - protein, 7 aa, Artificial Sequence
  Description of Artificial Sequence: example ZFP
QRDNLQR

SEQ ID NO: 932 - protein, 7 aa, Artificial Sequence
  Description of Artificial Sequence: example ZFP
RSDNLAR

SEQ ID NO: 933 - protein, 7 aa, Artificial Sequence
  Description of Artificial Sequence: example ZFP
QSGNLSR

SEQ ID NO: 934 - protein, 7 aa, Artificial Sequence
  Description of Artificial Sequence: example ZFP
QSGNLSR

SEQ ID NO: 935 - protein, 7 aa, Artificial Sequence
  Description of Artificial Sequence: example ZFP
QSGHLQR

SEQ ID NO: 936 - protein, 7 aa, Artificial Sequence
  Description of Artificial Sequence: example ZFP
QSGHLQR

SEQ ID NO: 937 - protein, 7 aa, Artificial Sequence
  Description of Artificial Sequence: example ZFP
QSGHLQR

SEQ ID NO: 938 - protein, 7 aa, Artificial Sequence
  Description of Artificial Sequence: example ZFP
NSDVLTS

SEQ ID NO: 939 - protein, 7 aa, Artificial Sequence
  Description of Artificial Sequence: example ZFP
NSDVLTS

SEQ ID NO: 940 - protein, 7 aa, Artificial Sequence
  Description of Artificial Sequence: example ZFP
NSADLTR

SEQ ID NO: 941 - protein, 7 aa, Artificial Sequence
  Description of Artificial Sequence: example ZFP
NSSALTS

SEQ ID NO: 942 - protein, 7 aa, Artificial Sequence
  Description of Artificial Sequence: example ZFP
DSGSLTR

SEQ ID NO: 943 - protein, 7 aa, Artificial Sequence
  Description of Artificial Sequence: example ZFP
RSDNLTR

SEQ ID NO: 944 - protein, 7 aa, Artificial Sequence
  Description of Artificial Sequence: example ZFP
TSGHLTR

SEQ ID NO: 945 - protein, 7 aa, Artificial Sequence
  Description of Artificial Sequence: example ZFP
RSDHLTR

SEQ ID NO: 946 - protein, 7 aa, Artificial Sequence
  Description of Artificial Sequence: example ZFP
QSDHLTR

SEQ ID NO: 947 - protein, 7 aa, Artificial Sequence
  Description of Artificial Sequence: example ZFP
RSDNLTR

SEQ ID NO: 948 - protein, 7 aa, Artificial Sequence
  Description of Artificial Sequence: example ZFP
RSDNLTR

SEQ ID NO: 949 - protein, 7 aa, Artificial Sequence
  Description of Artificial Sequence: example ZFP
RSDHLTK

SEQ ID NO: 950 - protein, 7 aa, Artificial Sequence
  Description of Artificial Sequence: example ZFP
RSDHLTK

SEQ ID NO: 951 - protein, 7 aa, Artificial Sequence
  Description of Artificial Sequence: example ZFP
RSDHLTK

SEQ ID NO: 952 - protein, 7 aa, Artificial Sequence
  Description of Artificial Sequence: example ZFP
QSSALTR

SEQ ID NO: 953 - protein, 7 aa, Artificial Sequence
  Description of Artificial Sequence: example ZFP
QSSVLTR

SEQ ID NO: 954 - protein, 7 aa, Artificial Sequence
  Description of Artificial Sequence: example ZFP
DSAVLTT

SEQ ID NO: 955 - protein, 7 aa, Artificial Sequence
  Description of Artificial Sequence: example ZFP
QASVLTR

SEQ ID NO: 956 - protein, 7 aa, Artificial Sequence
  Description of Artificial Sequence: example ZFP
QASHLTR

SEQ ID NO: 957 - protein, 7 aa, Artificial Sequence
  Description of Artificial Sequence: example ZFP
DSGHLTR

SEQ ID NO: 958 - protein, 7 aa, Artificial Sequence
  Description of Artificial Sequence: example ZFP
RSDHLTR

SEQ ID NO: 959 - protein, 7 aa, Artificial Sequence
  Description of Artificial Sequence: example ZFP
TGGSLAR

SEQ ID NO: 960 - protein, 7 aa, Artificial Sequence
  Description of Artificial Sequence: example ZFP
NRATLAR

SEQ ID NO: 961 - protein, 7 aa, Artificial Sequence
  Description of Artificial Sequence: example ZFP
NRATLAR

SEQ ID NO: 962 - protein, 7 aa, Artificial Sequence
  Description of Artificial Sequence: example ZFP
TGGSLAR

SEQ ID NO: 963 - protein, 7 aa, Artificial Sequence
  Description of Artificial Sequence: example ZFP
NRATLAR

SEQ ID NO: 964 - protein, 7 aa, Artificial Sequence
  Description of Artificial Sequence: example ZFP
RSDNLTR

SEQ ID NO: 965 - protein, 7 aa, Artificial Sequence
  Description of Artificial Sequence: example ZFP
QSGNLQR

SEQ ID NO: 966 - protein, 7 aa, Artificial Sequence
  Description of Artificial Sequence: example ZFP
RGDALTS

SEQ ID NO: 967 - protein, 7 aa, Artificial Sequence
  Description of Artificial Sequence: example ZFP
RSDNLTR

SEQ ID NO: 968 - protein, 7 aa, Artificial Sequence
  Description of Artificial Sequence: example ZFP
RSDNLTR

SEQ ID NO: 969 - protein, 7 aa, Artificial Sequence
  Description of Artificial Sequence: example ZFP
RSDELTT

SEQ ID NO: 970 - protein, 7 aa, Artificial Sequence
  Description of Artificial Sequence: example ZFP
QSSDLQR

SEQ ID NO: 971 - protein, 7 aa, Artificial Sequence
  Description of Artificial Sequence: example ZFP
RGDALTS

SEQ ID NO: 972 - protein, 7 aa, Artificial Sequence
  Description of Artificial Sequence: example ZFP
DRSHLAR

SEQ ID NO: 973 - protein, 7 aa, Artificial Sequence
  Description of Artificial Sequence: example ZFP
RSDTLKK

SEQ ID NO: 974 - protein, 7 aa, Artificial Sequence
  Description of Artificial Sequence: example ZFP
RSDELQR

SEQ ID NO: 975 - protein, 7 aa, Artificial Sequence
  Description of Artificial Sequence: example ZFP
RSDNLAR

SEQ ID NO: 976 - protein, 7 aa, Artificial Sequence
  Description of Artificial Sequence: example ZFP
RSDNLAR

SEQ ID NO: 977 - protein, 7 aa, Artificial Sequence
  Description of Artificial Sequence: example ZFP
QSSDLQK

SEQ ID NO: 978 - protein, 7 aa, Artificial Sequence
  Description of Artificial Sequence: example ZFP
QSSDLQK

SEQ ID NO: 979 - protein, 7 aa, Artificial Sequence
  Description of Artificial Sequence: example ZFP
QSGHLQR

SEQ ID NO: 980 - protein, 7 aa, Artificial Sequence
  Description of Artificial Sequence: example ZFP
QSGHLQR

SEQ ID NO: 981 - protein, 7 aa, Artificial Sequence
  Description of Artificial Sequence: example ZFP
RSDSLAR

SEQ ID NO: 982 - protein, 7 aa, Artificial Sequence
  Description of Artificial Sequence: example ZFP
ERGTLAR

SEQ ID NO: 983 - protein, 7 aa, Artificial Sequence
  Description of Artificial Sequence: example ZFP
DRSSLTR

SEQ ID NO: 984 - protein, 7 aa, Artificial Sequence
  Description of Artificial Sequence: example ZFP
ERGTLAR

SEQ ID NO: 985 - protein, 7 aa, Artificial Sequence
  Description of Artificial Sequence: example ZFP
DRSSLTR

SEQ ID NO: 986 - protein, 7 aa, Artificial Sequence
  Description of Artificial Sequence: example ZFP
ERGTLAR

SEQ ID NO: 987 - protein, 7 aa, Artificial Sequence
  Description of Artificial Sequence: example ZFP
QSGNLTR

SEQ ID NO: 988 - protein, 7 aa, Artificial Sequence
  Description of Artificial Sequence: example ZFP
RSDHLTT

SEQ ID NO: 989 - protein, 7 aa, Artificial Sequence
  Description of Artificial Sequence: example ZFP
RSDHLTT

SEQ ID NO: 990 - protein, 7 aa, Artificial Sequence
  Description of Artificial Sequence: example ZFP
RSDHLTT

SEQ ID NO: 991 - protein, 7 aa, Artificial Sequence
  Description of Artificial Sequence: example ZFP
QSANLQR

SEQ ID NO: 992 - protein, 7 aa, Artificial Sequence
  Description of Artificial Sequence: example ZFP
ERHSLQT

SEQ ID NO: 993 - protein, 7 aa, Artificial Sequence
  Description of Artificial Sequence: example ZFP
RSDELRR

SEQ ID NO: 994 - protein, 7 aa, Artificial Sequence
  Description of Artificial Sequence: example ZFP
RSDSLAR

SEQ ID NO: 995 - protein, 7 aa, Artificial Sequence
  Description of Artificial Sequence: example ZFP
RSDNLTR

SEQ ID NO: 996 - protein, 7 aa, Artificial Sequence
  Description of Artificial Sequence: example ZFP
TSGHLQR

SEQ ID NO: 997 - protein, 7 aa, Artificial Sequence
  Description of Artificial Sequence: example ZFP
DSAHLQR

SEQ ID NO: 998 - protein, 7 aa, Artificial Sequence
  Description of Artificial Sequence: example ZFP
RSDNLQR

SEQ ID NO: 999 - protein, 7 aa, Artificial Sequence
  Description of Artificial Sequence: example ZFP
TSSHLQK

SEQ ID NO: 1000 - protein, 7 aa, Artificial Sequence
  Description of Artificial Sequence: example ZFP
QSSNLQT

SEQ ID NO: 1001 - protein, 7 aa, Artificial Sequence
  Description of Artificial Sequence: example ZFP
RSDHLSR

SEQ ID NO: 1002 - protein, 7 aa, Artificial Sequence
  Description of Artificial Sequence: example ZFP
RSDALAR

SEQ ID NO: 1003 - protein, 7 aa, Artificial Sequence
  Description of Artificial Sequence: example ZFP
QRSALAR

SEQ ID NO: 1004 - protein, 7 aa, Artificial Sequence
  Description of Artificial Sequence: example ZFP
QSATLAR

SEQ ID NO: 1005 - protein, 7 aa, Artificial Sequence
  Description of Artificial Sequence: example ZFP
RSDALAR

SEQ ID NO: 1006 - protein, 7 aa, Artificial Sequence
  Description of Artificial Sequence: example ZFP
RSDNLAR

SEQ ID NO: 1007 - protein, 7 aa, Artificial Sequence
  Description of Artificial Sequence: example ZFP
RSDNLAR

SEQ ID NO: 1008 - protein, 7 aa, Artificial Sequence
  Description of Artificial Sequence: example ZFP
RSDALAR

SEQ ID NO: 1009 - protein, 7 aa, Artificial Sequence
  Description of Artificial Sequence: example ZFP
RSDALAR

SEQ ID NO: 1010 - protein, 7 aa, Artificial Sequence
  Description of Artificial Sequence: example ZFP
RSDALAR

SEQ ID NO: 1011 - protein, 7 aa, Artificial Sequence
  Description of Artificial Sequence: example ZFP
RSDNLTR

SEQ ID NO: 1012 - protein, 7 aa, Artificial Sequence
  Description of Artificial Sequence: example ZFP
QSGHLQR

SEQ ID NO: 1013 - protein, 7 aa, Artificial Sequence
  Description of Artificial Sequence: example ZFP
TSSELQR

SEQ ID NO: 1014 - protein, 7 aa, Artificial Sequence
  Description of Artificial Sequence: example ZFP
QSGHLQR

SEQ ID NO: 1015 - protein, 7 aa, Artificial Sequence
  Description of Artificial Sequence: example ZFP
RSDNLSR

SEQ ID NO: 1016 - protein, 7 aa, Artificial Sequence
  Description of Artificial Sequence: example ZFP
QSGHLQR

SEQ ID NO: 1017 - protein, 7 aa, Artificial Sequence
  Description of Artificial Sequence: example ZFP
QSGELQR

SEQ ID NO: 1018 - protein, 7 aa, Artificial Sequence
  Description of Artificial Sequence: example ZFP
RSDNLQR

SEQ ID NO: 1019 - protein, 7 aa, Artificial Sequence
  Description of Artificial Sequence: example ZFP
RSSNLQR

SEQ ID NO: 1020 - protein, 7 aa, Artificial Sequence
  Description of Artificial Sequence: example ZFP
RSSNLQR

SEQ ID NO: 1021 - protein, 7 aa, Artificial Sequence
  Description of Artificial Sequence: example ZFP
TSAELQR

SEQ ID NO: 1022 - protein, 7 aa, Artificial Sequence
  Description of Artificial Sequence: example ZFP
RSSNLQR

SEQ ID NO: 1023 - protein, 7 aa, Artificial Sequence
  Description of Artificial Sequence: example ZFP
RSSNLQR

SEQ ID NO: 1024 - protein, 7 aa, Artificial Sequence
  Description of Artificial Sequence: example ZFP
RSDNLAR

SEQ ID NO: 1025 - protein, 7 aa, Artificial Sequence
  Description of Artificial Sequence: example ZFP
RSDNLAR

SEQ ID NO: 1026 - protein, 7 aa, Artificial Sequence
  Description of Artificial Sequence: example ZFP
ESSDLQR

SEQ ID NO: 1027 - protein, 7 aa, Artificial Sequence
  Description of Artificial Sequence: example ZFP
RSDNLAR

SEQ ID NO: 1028 - protein, 7 aa, Artificial Sequence
  Description of Artificial Sequence: example ZFP
QSGSLTR

SEQ ID NO: 1029 - protein, 7 aa, Artificial Sequence
  Description of Artificial Sequence: example ZFP
RSSNLQR

SEQ ID NO: 1030 - protein, 7 aa, Artificial Sequence
  Description of Artificial Sequence: example ZFP
QRSNLVR

SEQ ID NO: 1031 - protein, 7 aa, Artificial Sequence
  Description of Artificial Sequence: example ZFP
QRSNLVR

SEQ ID NO: 1032 - protein, 7 aa, Artificial Sequence
  Description of Artificial Sequence: example ZFP
DKGNLQS

SEQ ID NO: 1033 - protein, 7 aa, Artificial Sequence
  Description of Artificial Sequence: example ZFP
DKGNLQS

SEQ ID NO: 1034 - protein, 7 aa, Artificial Sequence
  Description of Artificial Sequence: example ZFP
RSDHLTR

SEQ ID NO: 1035 - protein, 7 aa, Artificial Sequence
  Description of Artificial Sequence: example ZFP
RSDHLTR

SEQ ID NO: 1036 - protein, 7 aa, Artificial Sequence
  Description of Artificial Sequence: example ZFP
TSGHLTR

SEQ ID NO: 1037 - protein, 7 aa, Artificial Sequence
  Description of Artificial Sequence: example ZFP
RSDELQR

SEQ ID NO: 1038 - protein, 7 aa, Artificial Sequence
  Description of Artificial Sequence: example ZFP
NRDTLAR

SEQ ID NO: 1039 - protein, 7 aa, Artificial Sequence
  Description of Artificial Sequence: example ZFP
NRDTLAR

SEQ ID NO: 1040 - protein, 7 aa, Artificial Sequence
  Description of Artificial Sequence: example ZFP
RSDSLLR

SEQ ID NO: 1041 - protein, 7 aa, Artificial Sequence
  Description of Artificial Sequence: example ZFP
RSDHLTR

SEQ ID NO: 1042 - protein, 7 aa, Artificial Sequence
  Description of Artificial Sequence: example ZFP
DKSHLTR

SEQ ID NO: 1043 - protein, 7 aa, Artificial Sequence
  Description of Artificial Sequence: example ZFP
DSGHLTR

SEQ ID NO: 1044 - protein, 7 aa, Artificial Sequence
  Description of Artificial Sequence: example ZFP
TSGHLTR

SEQ ID NO: 1045 - protein, 7 aa, Artificial Sequence
  Description of Artificial Sequence: example ZFP
RSDHLTR

SEQ ID NO: 1046 - protein, 7 aa, Artificial Sequence
  Description of Artificial Sequence: example ZFP
QSATLAR

SEQ ID NO: 1047 - protein, 7 aa, Artificial Sequence
  Description of Artificial Sequence: example ZFP
RGDALTR

SEQ ID NO: 1048 - protein, 7 aa, Artificial Sequence
  Description of Artificial Sequence: example ZFP
RGDALTS

SEQ ID NO: 1049 - protein, 7 aa, Artificial Sequence
  Description of Artificial Sequence: example ZFP
RDGSLTS

SEQ ID NO: 1050 - protein, 7 aa, Artificial Sequence
  Description of Artificial Sequence: example ZFP
RDGSLTS

SEQ ID NO: 1051 - protein, 7 aa, Artificial Sequence
  Description of Artificial Sequence: example ZFP
RSDELRT

SEQ ID NO: 1052 - protein, 7 aa, Artificial Sequence
  Description of Artificial Sequence: example ZFP
RLDGLRT

SEQ ID NO: 1053 - protein, 7 aa, Artificial Sequence
  Description of Artificial Sequence: example ZFP
RQDTLVG

SEQ ID NO: 1054 - protein, 7 aa, Artificial Sequence
  Description of Artificial Sequence: example ZFP
RSDELRT

SEQ ID NO: 1055 - protein, 7 aa, Artificial Sequence
  Description of Artificial Sequence: example ZFP
RSDNLQR

SEQ ID NO: 1056 - protein, 7 aa, Artificial Sequence
  Description of Artificial Sequence: example ZFP
QRADLRR

SEQ ID NO: 1057 - protein, 7 aa, Artificial Sequence
  Description of Artificial Sequence: example ZFP
QRADLAR

SEQ ID NO: 1058 - protein, 7 aa, Artificial Sequence
  Description of Artificial Sequence: example ZFP
QRATLRR

SEQ ID NO: 1059 - protein, 7 aa, Artificial Sequence
  Description of Artificial Sequence: example ZFP
QRATLAR

SEQ ID NO: 1060 - protein, 7 aa, Artificial Sequence
  Description of Artificial Sequence: example ZFP
RSDNLSR

SEQ ID NO: 1061 - protein, 7 aa, Artificial Sequence
  Description of Artificial Sequence: example ZFP
RSDNLSR

SEQ ID NO: 1062 - protein, 7 aa, Artificial Sequence
  Description of Artificial Sequence: example ZFP
RSDNLAR

SEQ ID NO: 1063 - protein, 7 aa, Artificial Sequence
  Description of Artificial Sequence: example ZFP
RSDNLAS

SEQ ID NO: 1064 - protein, 7 aa, Artificial Sequence
  Description of Artificial Sequence: example ZFP
QRAHLAR

SEQ ID NO: 1065 - protein, 7 aa, Artificial Sequence
  Description of Artificial Sequence: example ZFP
QRAHLAR

SEQ ID NO: 1066 - protein, 7 aa, Artificial Sequence
  Description of Artificial Sequence: example ZFP
QRAHLAR

SEQ ID NO: 1067 - protein, 7 aa, Artificial Sequence
  Description of Artificial Sequence: example ZFP
QRAHLAR

SEQ ID NO: 1068 - protein, 7 aa, Artificial Sequence
  Description of Artificial Sequence: example ZFP
QSSALAR

SEQ ID NO: 1069 - protein, 7 aa, Artificial Sequence
  Description of Artificial Sequence: example ZFP
NRDTLAR

SEQ ID NO: 1070 - protein, 7 aa, Artificial Sequence
  Description of Artificial Sequence: example ZFP
QSANLSR

SEQ ID NO: 1071 - protein, 7 aa, Artificial Sequence
  Description of Artificial Sequence: example ZFP
QSANLSR

SEQ ID NO: 1072 - protein, 7 aa, Artificial Sequence
  Description of Artificial Sequence: example ZFP
RSDNLAR

SEQ ID NO: 1073 - protein, 7 aa, Artificial Sequence
  Description of Artificial Sequence: example ZFP
NRDNLSR

SEQ ID NO: 1074 - protein, 7 aa, Artificial Sequence
  Description of Artificial Sequence: example ZFP
QQSNLSR

SEQ ID NO: 1075 - protein, 7 aa, Artificial Sequence
  Description of Artificial Sequence: example ZFP
NRDNLAR

SEQ ID NO: 1076 - protein, 7 aa, Artificial Sequence
  Description of Artificial Sequence: example ZFP
NRDNLAR

SEQ ID NO: 1077 - protein, 7 aa, Artificial Sequence
  Description of Artificial Sequence: example ZFP
QQSNLAR

SEQ ID NO: 1078 - protein, 7 aa, Artificial Sequence
  Description of Artificial Sequence: example ZFP
QQSNLAR

SEQ ID NO: 1079 - protein, 7 aa, Artificial Sequence
  Description of Artificial Sequence: example ZFP
RSDHLTT

SEQ ID NO: 1080 - protein, 7 aa, Artificial Sequence
  Description of Artificial Sequence: example ZFP
QSGSLTR

SEQ ID NO: 1081 - protein, 7 aa, Artificial Sequence
  Description of Artificial Sequence: example ZFP
QSGSLTR

SEQ ID NO: 1082 - protein, 7 aa, Artificial Sequence
  Description of Artificial Sequence: example ZFP
QSGSLTR

SEQ ID NO: 1083 - protein, 7 aa, Artificial Sequence
  Description of Artificial Sequence: example ZFP
RSDELTR

SEQ ID NO: 1084 - protein, 7 aa, Artificial Sequence
  Description of Artificial Sequence: example ZFP
RSDELTR

SEQ ID NO: 1085 - protein, 7 aa, Artificial Sequence
  Description of Artificial Sequence: example ZFP
RSDELTR

SEQ ID NO: 1086 - protein, 7 aa, Artificial Sequence
  Description of Artificial Sequence: example ZFP
NRSHLAR

SEQ ID NO: 1087 - protein, 7 aa, Artificial Sequence
  Description of Artificial Sequence: example ZFP
QASHLAR

SEQ ID NO: 1088 - protein, 7 aa, Artificial Sequence
  Description of Artificial Sequence: example ZFP
QRGALAR

SEQ ID NO: 1089 - protein, 7 aa, Artificial Sequence
  Description of Artificial Sequence: example ZFP
RSDHLSR

SEQ ID NO: 1090 - protein, 7 aa, Artificial Sequence
  Description of Artificial Sequence: example ZFP
RSDHLSR

SEQ ID NO: 1091 - protein, 7 aa, Artificial Sequence
  Description of Artificial Sequence: example ZFP
RSDHLSR

SEQ ID NO: 1092 - protein, 7 aa, Artificial Sequence
  Description of Artificial Sequence: example ZFP
DRSHLAR

SEQ ID NO: 1093 - protein, 7 aa, Artificial Sequence
  Description of Artificial Sequence: example ZFP
QSGSLTR

SEQ ID NO: 1094 - protein, 7 aa, Artificial Sequence
  Description of Artificial Sequence: example ZFP
RSDHLSR

SEQ ID NO: 1095 - protein, 7 aa, Artificial Sequence
  Description of Artificial Sequence: example ZFP
RSDALAR

SEQ ID NO: 1096 - protein, 7 aa, Artificial Sequence
  Description of Artificial Sequence: example ZFP
QSGNLRT

SEQ ID NO: 1097 - protein, 7 aa, Artificial Sequence
  Description of Artificial Sequence: example ZFP
QSGNLRT

SEQ ID NO: 1098 - protein, 7 aa, Artificial Sequence
  Description of Artificial Sequence: example ZFP
QSGNLTR

SEQ ID NO: 1099 - protein, 7 aa, Artificial Sequence
  Description of Artificial Sequence: example ZFP
QSGNLRR

SEQ ID NO: 1100 - protein, 7 aa, Artificial Sequence
  Description of Artificial Sequence: example ZFP
RSDERKR

SEQ ID NO: 1101 - protein, 7 aa, Artificial Sequence
  Description of Artificial Sequence: example ZFP
RSDERKR

SEQ ID NO: 1102 - protein, 7 aa, Artificial Sequence
  Description of Artificial Sequence: example ZFP
RSDERKR

SEQ ID NO: 1103 - protein, 7 aa, Artificial Sequence
  Description of Artificial Sequence: example ZFP
RSDERKR

SEQ ID NO: 1104 - protein, 7 aa, Artificial Sequence
  Description of Artificial Sequence: example ZFP
RSDERKR

SEQ ID NO: 1105 - protein, 7 aa, Artificial Sequence
  Description of Artificial Sequence: example ZFP
RSDERKR

SEQ ID NO: 1106 - protein, 7 aa, Artificial Sequence
  Description of Artificial Sequence: example ZFP
QSADLAR

SEQ ID NO: 1107 - protein, 7 aa, Artificial Sequence
  Description of Artificial Sequence: example ZFP
QSGSLTR

SEQ ID NO: 1108 - protein, 7 aa, Artificial Sequence
  Description of Artificial Sequence: example ZFP
RSDERKR

SEQ ID NO: 1109 - protein, 7 aa, Artificial Sequence
  Description of Artificial Sequence: example ZFP
SRDHLQS

SEQ ID NO: 1110 - protein, 7 aa, Artificial Sequence
  Description of Artificial Sequence: example ZFP
QSGSLTR

SEQ ID NO: 1111 - protein, 7 aa, Artificial Sequence
  Description of Artificial Sequence: example ZFP
QSGSLTR

SEQ ID NO: 1112 - protein, 7 aa, Artificial Sequence
  Description of Artificial Sequence: example ZFP
QSGSLTR

SEQ ID NO: 1113 - protein, 7 aa, Artificial Sequence
  Description of Artificial Sequence: example ZFP
QSADLAR

SEQ ID NO: 1114 - protein, 7 aa, Artificial Sequence
  Description of Artificial Sequence: example ZFP
QSGSLTR

SEQ ID NO: 1115 - protein, 7 aa, Artificial Sequence
  Description of Artificial Sequence: example ZFP
RSDALTR

SEQ ID NO: 1116 - protein, 7 aa, Artificial Sequence
  Description of Artificial Sequence: example ZFP
DRDHLQS

SEQ ID NO: 1117 - protein, 7 aa, Artificial Sequence
  Description of Artificial Sequence: example ZFP
DRSHLQT

SEQ ID NO: 1118 - protein, 7 aa, Artificial Sequence
  Description of Artificial Sequence: example ZFP
TSGDLSR

SEQ ID NO: 1119 - protein, 7 aa, Artificial Sequence
  Description of Artificial Sequence: example ZFP
QSSDLQR

SEQ ID NO: 1120 - protein, 7 aa, Artificial Sequence
  Description of Artificial Sequence: example ZFP
QSSDLSR

SEQ ID NO: 1121 - protein, 7 aa, Artificial Sequence
  Description of Artificial Sequence: example ZFP
QSSDLSR

SEQ ID NO: 1122 - protein, 7 aa, Artificial Sequence
  Description of Artificial Sequence: example ZFP
QSSDLSR

SEQ ID NO: 1123 - protein, 7 aa, Artificial Sequence
  Description of Artificial Sequence: example ZFP
QSSDLSR

SEQ ID NO: 1124 - protein, 7 aa, Artificial Sequence
  Description of Artificial Sequence: example ZFP
QSSDLSR

SEQ ID NO: 1125 - protein, 7 aa, Artificial Sequence
  Description of Artificial Sequence: example ZFP
QSSDLSR

SEQ ID NO: 1126 - protein, 7 aa, Artificial Sequence
  Description of Artificial Sequence: example ZFP
QSSDLSR

SEQ ID NO: 1127 - protein, 7 aa, Artificial Sequence
  Description of Artificial Sequence: example ZFP
QSGNLSR

SEQ ID NO: 1128 - protein, 7 aa, Artificial Sequence
  Description of Artificial Sequence: example ZFP
QSANLQR

SEQ ID NO: 1129 - protein, 7 aa, Artificial Sequence
  Description of Artificial Sequence: example ZFP
QSGHLSR

SEQ ID NO: 1130 - protein, 7 aa, Artificial Sequence
  Description of Artificial Sequence: example ZFP
QSGHLSR

SEQ ID NO: 1131 - protein, 7 aa, Artificial Sequence
  Description of Artificial Sequence: example ZFP
QSGHLSR

SEQ ID NO: 1132 - protein, 7 aa, Artificial Sequence
  Description of Artificial Sequence: example ZFP
QSGHLSR

SEQ ID NO: 1133 - protein, 7 aa, Artificial Sequence
  Description of Artificial Sequence: example ZFP
QSGHLSR

SEQ ID NO: 1134 - protein, 7 aa, Artificial Sequence
  Description of Artificial Sequence: example ZFP
QSGHLSR

SEQ ID NO: 1135 - protein, 7 aa, Artificial Sequence
  Description of Artificial Sequence: example ZFP
QSGHLSR

SEQ ID NO: 1136 - protein, 7 aa, Artificial Sequence
  Description of Artificial Sequence: example ZFP
QSGHLSR

SEQ ID NO: 1137 - protein, 7 aa, Artificial Sequence
  Description of Artificial Sequence: example ZFP
RSDNLAS

SEQ ID NO: 1138 - protein, 7 aa, Artificial Sequence
  Description of Artificial Sequence: example ZFP
RSDHLSR

SEQ ID NO: 1139 - protein, 7 aa, Artificial Sequence
  Description of Artificial Sequence: example ZFP
RSDHLSR

SEQ ID NO: 1140 - protein, 7 aa, Artificial Sequence
  Description of Artificial Sequence: example ZFP
DRSHLTR

SEQ ID NO: 1141 - protein, 7 aa, Artificial Sequence
  Description of Artificial Sequence: example ZFP
DRDHLTR

SEQ ID NO: 1142 - protein, 7 aa, Artificial Sequence
  Description of Artificial Sequence: example ZFP
DRDHLTR

SEQ ID NO: 1143 - protein, 7 aa, Artificial Sequence
  Description of Artificial Sequence: example ZFP
QSDVLTR

SEQ ID NO: 1144 - protein, 7 aa, Artificial Sequence
  Description of Artificial Sequence: example ZFP
QSDVLTR

SEQ ID NO: 1145 - protein, 7 aa, Artificial Sequence
  Description of Artificial Sequence: example ZFP
NSDDLTR

SEQ ID NO: 1146 - protein, 7 aa, Artificial Sequence
  Description of Artificial Sequence: example ZFP
NSDDLTR

SEQ ID NO: 1147 - protein, 7 aa, Artificial Sequence
  Description of Artificial Sequence: example ZFP
TSGHLTR

SEQ ID NO: 1148 - protein, 7 aa, Artificial Sequence
  Description of Artificial Sequence: example ZFP
DCRDLTT

SEQ ID NO: 1149 - protein, 7 aa, Artificial Sequence
  Description of Artificial Sequence: example ZFP
TLHTLTR

SEQ ID NO: 1150 - protein, 7 aa, Artificial Sequence
  Description of Artificial Sequence: example ZFP
QSDHLTR

SEQ ID NO: 1151 - protein, 7 aa, Artificial Sequence
  Description of Artificial Sequence: example ZFP
TSGALTR

SEQ ID NO: 1152 - protein, 7 aa, Artificial Sequence
  Description of Artificial Sequence: example ZFP
QRSNLVR

SEQ ID NO: 1153 - protein, 7 aa, Artificial Sequence
  Description of Artificial Sequence: example ZFP
QRSNLVR

SEQ ID NO: 1154 - protein, 7 aa, Artificial Sequence
  Description of Artificial Sequence: example ZFP
DSDHLSR

SEQ ID NO: 1155 - protein, 7 aa, Artificial Sequence
  Description of Artificial Sequence: example ZFP
DSDHLSR

SEQ ID NO: 1156 - protein, 7 aa, Artificial Sequence
  Description of Artificial Sequence: example ZFP
DSSHLSR

SEQ ID NO: 1157 - protein, 7 aa, Artificial Sequence
  Description of Artificial Sequence: example ZFP
RSDHLTR

SEQ ID NO: 1158 - protein, 7 aa, Artificial Sequence
  Description of Artificial Sequence: example ZFP
RSDHLTR

SEQ ID NO: 1159 - protein, 7 aa, Artificial Sequence
  Description of Artificial Sequence: example ZFP
RSDSLTR

SEQ ID NO: 1160 - protein, 7 aa, Artificial Sequence
  Description of Artificial Sequence: example ZFP
QASHLTR

SEQ ID NO: 1161 - protein, 7 aa, Artificial Sequence
  Description of Artificial Sequence: example ZFP
RSDNLTR

SEQ ID NO: 1162 - protein, 7 aa, Artificial Sequence
  Description of Artificial Sequence: example ZFP
RSDHLQR

SEQ ID NO: 1163 - protein, 7 aa, Artificial Sequence
  Description of Artificial Sequence: example ZFP
RSDNLTR

SEQ ID NO: 1164 - protein, 7 aa, Artificial Sequence
  Description of Artificial Sequence: example ZFP
QSGSLTR

SEQ ID NO: 1165 - protein, 7 aa, Artificial Sequence
  Description of Artificial Sequence: example ZFP
QSASLTR

SEQ ID NO: 1166 - protein, 7 aa, Artificial Sequence
  Description of Artificial Sequence: example ZFP
QSGSLTR

SEQ ID NO: 1167 - protein, 7 aa, Artificial Sequence
  Description of Artificial Sequence: example ZFP
QSASLTR

SEQ ID NO: 1168 - protein, 7 aa, Artificial Sequence
  Description of Artificial Sequence: example ZFP
QSASLTR

SEQ ID NO: 1169 - protein, 7 aa, Artificial Sequence
  Description of Artificial Sequence: example ZFP
TSSELQR

SEQ ID NO: 1170 - protein, 7 aa, Artificial Sequence
  Description of Artificial Sequence: example ZFP
RSDNLTR

SEQ ID NO: 1171 - protein, 7 aa, Artificial Sequence
  Description of Artificial Sequence: example ZFP
RSDALTR

SEQ ID NO: 1172 - protein, 7 aa, Artificial Sequence
  Description of Artificial Sequence: example ZFP
DRSSLTR

SEQ ID NO: 1173 - protein, 7 aa, Artificial Sequence
  Description of Artificial Sequence: example ZFP
ERGTLAR

SEQ ID NO: 1174 - protein, 7 aa, Artificial Sequence
  Description of Artificial Sequence: example ZFP
RSDNLAR

SEQ ID NO: 1175 - protein, 7 aa, Artificial Sequence
  Description of Artificial Sequence: example ZFP
QSGDLTR

SEQ ID NO: 1176 - protein, 7 aa, Artificial Sequence
  Description of Artificial Sequence: example ZFP
RSDHLTT

SEQ ID NO: 1177 - protein, 7 aa, Artificial Sequence
  Description of Artificial Sequence: example ZFP
RSDALAR

SEQ ID NO: 1178 - protein, 7 aa, Artificial Sequence
  Description of Artificial Sequence: example ZFP
RSDHLSR

SEQ ID NO: 1179 - protein, 7 aa, Artificial Sequence
  Description of Artificial Sequence: example ZFP
RSDHLSR

SEQ ID NO: 1180 - protein, 7 aa, Artificial Sequence
  Description of Artificial Sequence: example ZFP
DRSHLAR

SEQ ID NO: 1181 - protein, 7 aa, Artificial Sequence
  Description of Artificial Sequence: example ZFP
DRSHLAR

SEQ ID NO: 1182 - protein, 7 aa, Artificial Sequence
  Description of Artificial Sequence: example ZFP
RSDALAR

SEQ ID NO: 1183 - protein, 7 aa, Artificial Sequence
  Description of Artificial Sequence: example ZFP
RSDALAR

SEQ ID NO: 1184 - protein, 7 aa, Artificial Sequence
  Description of Artificial Sequence: example ZFP
RSDTLKK

SEQ ID NO: 1185 - protein, 7 aa, Artificial Sequence
  Description of Artificial Sequence: example ZFP
RSDTLKK

SEQ ID NO: 1186 - protein, 7 aa, Artificial Sequence
  Description of Artificial Sequence: example ZFP
QSGDLRT

SEQ ID NO: 1187 - protein, 7 aa, Artificial Sequence
  Description of Artificial Sequence: example ZFP
RSDERKR

SEQ ID NO: 1188 - protein, 7 aa, Artificial Sequence
  Description of Artificial Sequence: example ZFP
RSDERKR

SEQ ID NO: 1189 - protein, 7 aa, Artificial Sequence
  Description of Artificial Sequence: example ZFP
RSDERKR

SEQ ID NO: 1190 - protein, 7 aa, Artificial Sequence
  Description of Artificial Sequence: example ZFP
RSDERKR

SEQ ID NO: 1191 - protein, 7 aa, Artificial Sequence
  Description of Artificial Sequence: example ZFP
RSDERKR

SEQ ID NO: 1192 - protein, 7 aa, Artificial Sequence
  Description of Artificial Sequence: example ZFP
QSGSLTR

SEQ ID NO: 1193 - protein, 7 aa, Artificial Sequence
  Description of Artificial Sequence: example ZFP
RSDERKR

SEQ ID NO: 1194 - protein, 7 aa, Artificial Sequence
  Description of Artificial Sequence: example ZFP
RSDERKR

SEQ ID NO: 1195 - protein, 7 aa, Artificial Sequence
  Description of Artificial Sequence: example ZFP
RSDERKR

SEQ ID NO: 1196 - protein, 7 aa, Artificial Sequence
  Description of Artificial Sequence: example ZFP
QSGSLTR

SEQ ID NO: 1197 - protein, 7 aa, Artificial Sequence
  Description of Artificial Sequence: example ZFP
RSDALTR

SEQ ID NO: 1198 - protein, 7 aa, Artificial Sequence
  Description of Artificial Sequence: example ZFP
DRSHLQT

SEQ ID NO: 1199 - protein, 7 aa, Artificial Sequence
  Description of Artificial Sequence: example ZFP
RSDHLSR

SEQ ID NO: 1200 - protein, 7 aa, Artificial Sequence
  Description of Artificial Sequence: example ZFP
DRSSLTR

SEQ ID NO: 1201 - protein, 7 aa, Artificial Sequence
  Description of Artificial Sequence: example ZFP
TSGHLSR

SEQ ID NO: 1202 - protein, 7 aa, Artificial Sequence
  Description of Artificial Sequence: example ZFP
TSSALSR

SEQ ID NO: 1203 - protein, 7 aa, Artificial Sequence
  Description of Artificial Sequence: example ZFP
QSGNLSR

SEQ ID NO: 1204 - protein, 7 aa, Artificial Sequence
  Description of Artificial Sequence: example ZFP
DTDHLRR

SEQ ID NO: 1205 - protein, 7 aa, Artificial Sequence
  Description of Artificial Sequence: example ZFP
DRSHLAR

SEQ ID NO: 1206 - protein, 7 aa, Artificial Sequence
  Description of Artificial Sequence: example ZFP
RSDALAR

SEQ ID NO: 1207 - protein, 7 aa, Artificial Sequence
  Description of Artificial Sequence: example ZFP
RSDHLSR

SEQ ID NO: 1208 - protein, 7 aa, Artificial Sequence
  Description of Artificial Sequence: example ZFP
RSDNLAR

SEQ ID NO: 1209 - protein, 7 aa, Artificial Sequence
  Description of Artificial Sequence: example ZFP
RSDNLAR

SEQ ID NO: 1210 - protein, 7 aa, Artificial Sequence
  Description of Artificial Sequence: example ZFP
DRSALAR

SEQ ID NO: 1211 - protein, 7 aa, Artificial Sequence
  Description of Artificial Sequence: example ZFP
NRATLAR

SEQ ID NO: 1212 - protein, 7 aa, Artificial Sequence
  Description of Artificial Sequence: example ZFP
QSSALAR

SEQ ID NO: 1213 - protein, 7 aa, Artificial Sequence
  Description of Artificial Sequence: example ZFP
RSDNLAR

SEQ ID NO: 1214 - protein, 7 aa, Artificial Sequence
  Description of Artificial Sequence: example ZFP
RSDNLAR

SEQ ID NO: 1215 - protein, 7 aa, Artificial Sequence
  Description of Artificial Sequence: example ZFP
RSDNLTT

SEQ ID NO: 1216 - protein, 7 aa, Artificial Sequence
  Description of Artificial Sequence: example ZFP
RSDHLTT

SEQ ID NO: 1217 - protein, 7 aa, Artificial Sequence
  Description of Artificial Sequence: example ZFP
QSGHLSR

SEQ ID NO: 1218 - protein, 7 aa, Artificial Sequence
  Description of Artificial Sequence: example ZFP
QSGHLSR

SEQ ID NO: 1219 - protein, 7 aa, Artificial Sequence
  Description of Artificial Sequence: example ZFP
RSDHLSR

SEQ ID NO: 1220 - protein, 7 aa, Artificial Sequence
  Description of Artificial Sequence: example ZFP
RSDHLSR

SEQ ID NO: 1221 - protein, 7 aa, Artificial Sequence
  Description of Artificial Sequence: example ZFP
QSGHLSR

SEQ ID NO: 1222 - protein, 7 aa, Artificial Sequence
  Description of Artificial Sequence: example ZFP
QSGELSR

SEQ ID NO: 1223 - protein, 7 aa, Artificial Sequence
  Description of Artificial Sequence: example ZFP
TSANLSR

SEQ ID NO: 1224 - protein, 7 aa, Artificial Sequence
  Description of Artificial Sequence: example ZFP
RSDHLSR

SEQ ID NO: 1225 - protein, 7 aa, Artificial Sequence
  Description of Artificial Sequence: example ZFP
RSDHLSR

SEQ ID NO: 1226 - protein, 7 aa, Artificial Sequence
  Description of Artificial Sequence: example ZFP
RSSNLSR

SEQ ID NO: 1227 - protein, 7 aa, Artificial Sequence
  Description of Artificial Sequence: example ZFP
RSDELSR

SEQ ID NO: 1228 - protein, 7 aa, Artificial Sequence
  Description of Artificial Sequence: example ZFP
RSDELSR

SEQ ID NO: 1229 - protein, 7 aa, Artificial Sequence
  Description of Artificial Sequence: example ZFP
RSADLSR

SEQ ID NO: 1230 - protein, 7 aa, Artificial Sequence
  Description of Artificial Sequence: example ZFP
RSDDLRR

SEQ ID NO: 1231 - protein, 7 aa, Artificial Sequence
  Description of Artificial Sequence: example ZFP
QSGELSR

SEQ ID NO: 1232 - protein, 7 aa, Artificial Sequence
  Description of Artificial Sequence: example ZFP
QSGSLTR

SEQ ID NO: 1233 - protein, 7 aa, Artificial Sequence
  Description of Artificial Sequence: example ZFP
RSDHLTT

SEQ ID NO: 1234 - protein, 7 aa, Artificial Sequence
  Description of Artificial Sequence: example ZFP
RSDHLSR

SEQ ID NO: 1235 - protein, 7 aa, Artificial Sequence
  Description of Artificial Sequence: example ZFP
RSDHLTR

SEQ ID NO: 1236 - protein, 7 aa, Artificial Sequence
  Description of Artificial Sequence: example ZFP
RSDSLLR

SEQ ID NO: 1237 - protein, 7 aa, Artificial Sequence
  Description of Artificial Sequence: example ZFP
QSDDLTR

SEQ ID NO: 1238 - protein, 7 aa, Artificial Sequence
  Description of Artificial Sequence: example ZFP
QSGDLTR

SEQ ID NO: 1239 - protein, 7 aa, Artificial Sequence
  Description of Artificial Sequence: example ZFP
DKGNLQT

SEQ ID NO: 1240 - protein, 7 aa, Artificial Sequence
  Description of Artificial Sequence: example ZFP
DKGNLQT

SEQ ID NO: 1241 - protein, 7 aa, Artificial Sequence
  Description of Artificial Sequence: example ZFP
RSDNLTR

SEQ ID NO: 1242 - protein, 7 aa, Artificial Sequence
  Description of Artificial Sequence: example ZFP
QSDHLTR

SEQ ID NO: 1243 - protein, 7 aa, Artificial Sequence
  Description of Artificial Sequence: example ZFP
TSGHLTR

SEQ ID NO: 1244 - protein, 7 aa, Artificial Sequence
  Description of Artificial Sequence: example ZFP
TSGHLTR

SEQ ID NO: 1245 - protein, 7 aa, Artificial Sequence
  Description of Artificial Sequence: example ZFP
DKGNLQT

SEQ ID NO: 1246 - protein, 7 aa, Artificial Sequence
  Description of Artificial Sequence: example ZFP
QSASLTR

SEQ ID NO: 1247 - protein, 7 aa, Artificial Sequence
  Description of Artificial Sequence: example ZFP
QSGNLTR

SEQ ID NO: 1248 - protein, 7 aa, Artificial Sequence
  Description of Artificial Sequence: example ZFP
QSGNLTR

SEQ ID NO: 1249 - protein, 7 aa, Artificial Sequence
  Description of Artificial Sequence: example ZFP
RSDHLSK

SEQ ID NO: 1250 - protein, 7 aa, Artificial Sequence
  Description of Artificial Sequence: example ZFP
RSDHLSK

SEQ ID NO: 1251 - protein, 7 aa, Artificial Sequence
  Description of Artificial Sequence: example ZFP
QSDHLTR

SEQ ID NO: 1252 - protein, 7 aa, Artificial Sequence
  Description of Artificial Sequence: example ZFP
RSDHLTT

SEQ ID NO: 1253 - protein, 7 aa, Artificial Sequence
  Description of Artificial Sequence: example ZFP
RSDHLTT

SEQ ID NO: 1254 - protein, 7 aa, Artificial Sequence
  Description of Artificial Sequence: example ZFP
RSDHLTT

SEQ ID NO: 1255 - protein, 7 aa, Artificial Sequence
  Description of Artificial Sequence: example ZFP
RSDHLTT

SEQ ID NO: 1256 - protein, 7 aa, Artificial Sequence
  Description of Artificial Sequence: example ZFP
RSDNLAR

SEQ ID NO: 1257 - protein, 7 aa, Artificial Sequence
  Description of Artificial Sequence: example ZFP
RSDNLAR

SEQ ID NO: 1258 - protein, 7 aa, Artificial Sequence
  Description of Artificial Sequence: example ZFP
RSDNLAR

SEQ ID NO: 1259 - protein, 7 aa, Artificial Sequence
  Description of Artificial Sequence: example ZFP
RSDNLAR

SEQ ID NO: 1260 - protein, 7 aa, Artificial Sequence
  Description of Artificial Sequence: example ZFP
RSDHLSR

SEQ ID NO: 1261 - DNA, 10 bp, Artificial Sequence
  Description of Artificial Sequence: example target DNA
gaggaggtga

SEQ ID NO: 1262 - DNA, 10 bp, Artificial Sequence
  Description of Artificial Sequence: example target DNA
gcggaggacc

SEQ ID NO: 1263 - DNA, 10 bp, Artificial Sequence
  Description of Artificial Sequence: example target DNA
gaggaggtga

SEQ ID NO: 1264 - DNA, 10 bp, Artificial Sequence
  Description of Artificial Sequence: example target DNA
gaggaggtga

SEQ ID NO: 1265 - DNA, 10 bp, Artificial Sequence
  Description of Artificial Sequence: example target DNA
gcggaggcgc

SEQ ID NO: 1266 - DNA, 10 bp, Artificial Sequence
  Description of Artificial Sequence: example target DNA
gcggaggacc

SEQ ID NO: 1267 - DNA, 10 bp, Artificial Sequence
  Description of Artificial Sequence: example target DNA
gacgtggagg

SEQ ID NO: 1268 - DNA, 10 bp, Artificial Sequence
  Description of Artificial Sequence: example target DNA
aaggagtcgc

SEQ ID NO: 1269 - DNA, 10 bp, Artificial Sequence
  Description of Artificial Sequence: example target DNA
gtggaggcca

SEQ ID NO: 1270 - DNA, 10 bp, Artificial Sequence
  Description of Artificial Sequence: example target DNA
atggattcag

SEQ ID NO: 1271 - DNA, 10 bp, Artificial Sequence
  Description of Artificial Sequence: example target DNA
gggggagctg

SEQ ID NO: 1272 - DNA, 10 bp, Artificial Sequence
  Description of Artificial Sequence: example target DNA
gggggagctg

SEQ ID NO: 1273 - DNA, 10 bp, Artificial Sequence
  Description of Artificial Sequence: example target DNA
gaggtgggct

SEQ ID NO: 1274 - DNA, 10 bp, Artificial Sequence
  Description of Artificial Sequence: example target DNA
tcagtggtat

SEQ ID NO: 1275 - DNA, 10 bp, Artificial Sequence
  Description of Artificial Sequence: example target DNA
atggattcag

SEQ ID NO: 1276 - DNA, 10 bp, Artificial Sequence
  Description of Artificial Sequence: example target DNA
tcagtggtat

SEQ ID NO: 1277 - DNA, 10 bp, Artificial Sequence
  Description of Artificial Sequence: example target DNA
gcgggcgggc

SEQ ID NO: 1278 - DNA, 10 bp, Artificial Sequence
  Description of Artificial Sequence: example target DNA
caggctgtgg

SEQ ID NO: 1279 - DNA, 10 bp, Artificial Sequence
  Description of Artificial Sequence: example target DNA
gcagaggctg

SEQ ID NO: 1280 - DNA, 10 bp, Artificial Sequence
  Description of Artificial Sequence: example target DNA
tcagtggtat

SEQ ID NO: 1281 - DNA, 10 bp, Artificial Sequence
  Description of Artificial Sequence: example target DNA
tcagtggtat

SEQ ID NO: 1282 - DNA, 10 bp, Artificial Sequence
  Description of Artificial Sequence: example target DNA
tcggacgtgg

SEQ ID NO: 1283 - DNA, 10 bp, Artificial Sequence
  Description of Artificial Sequence: example target DNA
ggggaggccc

SEQ ID NO: 1284 - DNA, 10 bp, Artificial Sequence
  Description of Artificial Sequence: example target DNA
gcggcgtcgg

SEQ ID NO: 1285 - DNA, 10 bp, Artificial Sequence
  Description of Artificial Sequence: example target DNA
ggggccctgg

SEQ ID NO: 1286 - DNA, 10 bp, Artificial Sequence
  Description of Artificial Sequence: example target DNA
gaatgggcag

SEQ ID NO: 1287 - DNA, 10 bp, Artificial Sequence
  Description of Artificial Sequence: example target DNA
gcgggtgtct

SEQ ID NO: 1288 - DNA, 10 bp, Artificial Sequence
  Description of Artificial Sequence: example target DNA
ggggaggccc

SEQ ID NO: 1289 - DNA, 10 bp, Artificial Sequence
  Description of Artificial Sequence: example target DNA
agagcggcac

SEQ ID NO: 1290 - DNA, 10 bp, Artificial Sequence
  Description of Artificial Sequence: example target DNA
gagtcggacg

SEQ ID NO: 1291 - DNA, 10 bp, Artificial Sequence
  Description of Artificial Sequence: example target DNA
gcagcggctc

SEQ ID NO: 1292 - DNA, 10 bp, Artificial Sequence
  Description of Artificial Sequence: example target DNA
tcggacgagt

SEQ ID NO: 1293 - DNA, 10 bp, Artificial Sequence
  Description of Artificial Sequence: example target DNA
gagatggatc

SEQ ID NO: 1294 - DNA, 10 bp, Artificial Sequence
  Description of Artificial Sequence: example target DNA
gcagcggctc

SEQ ID NO: 1295 - DNA, 10 bp, Artificial Sequence
  Description of Artificial Sequence: example target DNA
gacgagtcgg

SEQ ID NO: 1296 - DNA, 10 bp, Artificial Sequence
  Description of Artificial Sequence: example target DNA
gctgcaggag

SEQ ID NO: 1297 - DNA, 10 bp, Artificial Sequence
  Description of Artificial Sequence: example target DNA
gagatggatc

SEQ ID NO: 1298 - DNA, 10 bp, Artificial Sequence
  Description of Artificial Sequence: example target DNA
agagcggcac

SEQ ID NO: 1299 - DNA, 10 bp, Artificial Sequence
  Description of Artificial Sequence: example target DNA
gcggggtccg

SEQ ID NO: 1300 - DNA, 10 bp, Artificial Sequence
  Description of Artificial Sequence: example target DNA
agagcggcac

SEQ ID NO: 1301 - DNA, 10 bp, Artificial Sequence
  Description of Artificial Sequence: example target DNA
gactaggacc

SEQ ID NO: 1302 - DNA, 10 bp, Artificial Sequence
  Description of Artificial Sequence: example target DNA
gctgcaggag

SEQ ID NO: 1303 - DNA, 10 bp, Artificial Sequence
  Description of Artificial Sequence: example target DNA
tagggagcgt

SEQ ID NO: 1304 - DNA, 10 bp, Artificial Sequence
  Description of Artificial Sequence: example target DNA
tagggagcgt

SEQ ID NO: 1305 - DNA, 10 bp, Artificial Sequence
  Description of Artificial Sequence: example target DNA
gaatgggcag

SEQ ID NO: 1306 - DNA, 10 bp, Artificial Sequence
  Description of Artificial Sequence: example target DNA
gactaggacc

SEQ ID NO: 1307 - DNA, 10 bp, Artificial Sequence
  Description of Artificial Sequence: example target DNA
ggggccctgg

SEQ ID NO: 1308 - DNA, 10 bp, Artificial Sequence
  Description of Artificial Sequence: example target DNA
gcagaggctg

SEQ ID NO: 1309 - DNA, 10 bp, Artificial Sequence
  Description of Artificial Sequence: example target DNA
gcagcggtag

SEQ ID NO: 1310 - DNA, 10 bp, Artificial Sequence
  Description of Artificial Sequence: example target DNA
gccgaggccg

SEQ ID NO: 1311 - DNA, 10 bp, Artificial Sequence
  Description of Artificial Sequence: example target DNA
gccgaggccg

SEQ ID NO: 1312 - DNA, 10 bp, Artificial Sequence
  Description of Artificial Sequence: example target DNA
gcagcggtag

SEQ ID NO: 1313 - DNA, 10 bp, Artificial Sequence
  Description of Artificial Sequence: example target DNA
gcagaggctg

SEQ ID NO: 1314 - DNA, 10 bp, Artificial Sequence
  Description of Artificial Sequence: example target DNA
ggggccctgg

SEQ ID NO: 1315 - DNA, 10 bp, Artificial Sequence
  Description of Artificial Sequence: example target DNA
gagtgtgagg

SEQ ID NO: 1316 - DNA, 10 bp, Artificial Sequence
  Description of Artificial Sequence: example target DNA
ttggcagcct

SEQ ID NO: 1317 - DNA, 10 bp, Artificial Sequence
  Description of Artificial Sequence: example target DNA
gggggagctg

SEQ ID NO: 1318 - DNA, 10 bp, Artificial Sequence
  Description of Artificial Sequence: example target DNA
ttggcagcct

SEQ ID NO: 1319 - DNA, 10 bp, Artificial Sequence
  Description of Artificial Sequence: example target DNA
gactaggacc

SEQ ID NO: 1320 - DNA, 10 bp, Artificial Sequence
  Description of Artificial Sequence: example target DNA
gagatggatc

SEQ ID NO: 1321 - DNA, 10 bp, Artificial Sequence
  Description of Artificial Sequence: example target DNA
gctgcaggag

SEQ ID NO: 1322 - DNA, 10 bp, Artificial Sequence
  Description of Artificial Sequence: example target DNA
gcagcggtag

SEQ ID NO: 1323 - DNA, 10 bp, Artificial Sequence
  Description of Artificial Sequence: example target DNA
gagtgtgagg

SEQ ID NO: 1324 - DNA, 10 bp, Artificial Sequence
  Description of Artificial Sequence: example target DNA
gagtgtgagg

SEQ ID NO: 1325 - DNA, 10 bp, Artificial Sequence
  Description of Artificial Sequence: example target DNA
ggagagtcgg

SEQ ID NO: 1326 - DNA, 10 bp, Artificial Sequence
  Description of Artificial Sequence: example target DNA
ggagagtcgg

SEQ ID NO: 1327 - DNA, 10 bp, Artificial Sequence
  Description of Artificial Sequence: example target DNA
gctgcaggag

SEQ ID NO: 1328 - DNA, 10 bp, Artificial Sequence
  Description of Artificial Sequence: example target DNA
gagatggatc

SEQ ID NO: 1329 - DNA, 10 bp, Artificial Sequence
  Description of Artificial Sequence: example target DNA
aagtagggtg

SEQ ID NO: 1330 - DNA, 10 bp, Artificial Sequence
  Description of Artificial Sequence: example target DNA
acggtagtta

SEQ ID NO: 1331 - DNA, 10 bp, Artificial Sequence
  Description of Artificial Sequence: example target DNA
acggtagtta

SEQ ID NO: 1332 - DNA, 10 bp, Artificial Sequence
  Description of Artificial Sequence: example target DNA
gtgtgctggt

SEQ ID NO: 1333 - DNA, 10 bp, Artificial Sequence
  Description of Artificial Sequence: example target DNA
gtgtgctggt

SEQ ID NO: 1334 - DNA, 10 bp, Artificial Sequence
  Description of Artificial Sequence: example target DNA
gtgtgctggt

SEQ ID NO: 1335 - DNA, 10 bp, Artificial Sequence
  Description of Artificial Sequence: example target DNA
gtgtgctggt

SEQ ID NO: 1336 - DNA, 10 bp, Artificial Sequence
  Description of Artificial Sequence: example target DNA
tcagtggtat

SEQ ID NO: 1337 - DNA, 10 bp, Artificial Sequence
  Description of Artificial Sequence: example target DNA
atggattcag

SEQ ID NO: 1338 - DNA, 10 bp, Artificial Sequence
  Description of Artificial Sequence: example target DNA
ctggtatgtc

SEQ ID NO: 1339 - DNA, 10 bp, Artificial Sequence
  Description of Artificial Sequence: example target DNA
aagtagggtg

SEQ ID NO: 1340 - DNA, 10 bp, Artificial Sequence
  Description of Artificial Sequence: example target DNA
acggtagtta

SEQ ID NO: 1341 - DNA, 10 bp, Artificial Sequence
  Description of Artificial Sequence: example target DNA
ctggtatgtc

SEQ ID NO: 1342 - DNA, 10 bp, Artificial Sequence
  Description of Artificial Sequence: example target DNA
ctggtatgtc

SEQ ID NO: 1343 - DNA, 10 bp, Artificial Sequence
  Description of Artificial Sequence: example target DNA
ctggtatgtc

SEQ ID NO: 1344 - DNA, 10 bp, Artificial Sequence
  Description of Artificial Sequence: example target DNA
gcagcggtag

SEQ ID NO: 1345 - DNA, 10 bp, Artificial Sequence
  Description of Artificial Sequence: example target DNA
gggggagctg

SEQ ID NO: 1346 - DNA, 10 bp, Artificial Sequence
  Description of Artificial Sequence: example target DNA
gctgcaggag

SEQ ID NO: 1347 - protein, 7 aa, Artificial Sequence
  Description of Artificial Sequence: example ZFP
RSDALAR

SEQ ID NO: 1348 - protein, 7 aa, Artificial Sequence
  Description of Artificial Sequence: example ZFP
EKANLTR

SEQ ID NO: 1349 - protein, 7 aa, Artificial Sequence
  Description of Artificial Sequence: example ZFP
RSDSLTR

SEQ ID NO: 1350 - protein, 7 aa, Artificial Sequence
  Description of Artificial Sequence: example ZFP
RSDSLTR

SEQ ID NO: 1351 - protein, 7 aa, Artificial Sequence
  Description of Artificial Sequence: example ZFP
RSDDLTR

SEQ ID NO: 1352 - protein, 7 aa, Artificial Sequence
  Description of Artificial Sequence: example ZFP
EKANLTR

SEQ ID NO: 1353 - protein, 7 aa, Artificial Sequence
  Description of Artificial Sequence: example ZFP
RSDNLAR

SEQ ID NO: 1354 - protein, 7 aa, Artificial Sequence
  Description of Artificial Sequence: example ZFP
RSADLRT

SEQ ID NO: 1355 - protein, 7 aa, Artificial Sequence
  Description of Artificial Sequence: example ZFP
ERGTLAR

SEQ ID NO: 1356 - protein, 7 aa, Artificial Sequence
  Description of Artificial Sequence: example ZFP
QSHDLTK

SEQ ID NO: 1357 - protein, 7 aa, Artificial Sequence
  Description of Artificial Sequence: example ZFP
QSSDLQR

SEQ ID NO: 1358 - protein, 7 aa, Artificial Sequence
  Description of Artificial Sequence: example ZFP
QSSDLQR

SEQ ID NO: 1359 - protein, 7 aa, Artificial Sequence
  Description of Artificial Sequence: example ZFP
DRSHLTR

SEQ ID NO: 1360 - protein, 7 aa, Artificial Sequence
  Description of Artificial Sequence: example ZFP
QRSALAR

SEQ ID NO: 1361 - protein, 7 aa, Artificial Sequence
  Description of Artificial Sequence: example ZFP
QSHDLTK

SEQ ID NO: 1362 - protein, 7 aa, Artificial Sequence
  Description of Artificial Sequence: example ZFP
QSSSLVR

SEQ ID NO: 1363 - protein, 7 aa, Artificial Sequence
  Description of Artificial Sequence: example ZFP
RSDHLTR

SEQ ID NO: 1364 - protein, 7 aa, Artificial Sequence
  Description of Artificial Sequence: example ZFP
RSDALTR

SEQ ID NO: 1365 - protein, 7 aa, Artificial Sequence
  Description of Artificial Sequence: example ZFP
QSSDLQR

SEQ ID NO: 1366 - protein, 7 aa, Artificial Sequence
  Description of Artificial Sequence: example ZFP
QSSSLVR

SEQ ID NO: 1367 - protein, 7 aa, Artificial Sequence
  Description of Artificial Sequence: example ZFP
QRSALAR

SEQ ID NO: 1368 - protein, 7 aa, Artificial Sequence
  Description of Artificial Sequence: example ZFP
RSDALAR

SEQ ID NO: 1369 - protein, 7 aa, Artificial Sequence
  Description of Artificial Sequence: example ZFP
ERGTLAR

SEQ ID NO: 1370 - protein, 7 aa, Artificial Sequence
  Description of Artificial Sequence: example ZFP
RSDELRT

SEQ ID NO: 1371 - protein, 7 aa, Artificial Sequence
  Description of Artificial Sequence: example ZFP
RSDALRE

SEQ ID NO: 1372 - protein, 7 aa, Artificial Sequence
  Description of Artificial Sequence: example ZFP
QSGSLTR

SEQ ID NO: 1373 - protein, 7 aa, Artificial Sequence
  Description of Artificial Sequence: example ZFP
DRSALAR

SEQ ID NO: 1374 - protein, 7 aa, Artificial Sequence
  Description of Artificial Sequence: example ZFP
DRSSLTR

SEQ ID NO: 1375 - protein, 7 aa, Artificial Sequence
  Description of Artificial Sequence: example ZFP
QTGSLTR

SEQ ID NO: 1376 - protein, 7 aa, Artificial Sequence
  Description of Artificial Sequence: example ZFP
DRSNLTR

SEQ ID NO: 1377 - protein, 7 aa, Artificial Sequence
  Description of Artificial Sequence: example ZFP
QSSDLQR

SEQ ID NO: 1378 - protein, 7 aa, Artificial Sequence
  Description of Artificial Sequence: example ZFP
RSDNLAR

SEQ ID NO: 1379 - protein, 7 aa, Artificial Sequence
  Description of Artificial Sequence: example ZFP
QSSNLQR

SEQ ID NO: 1380 - protein, 7 aa, Artificial Sequence
  Description of Artificial Sequence: example ZFP
QSSDLQR

SEQ ID NO: 1381 - protein, 7 aa, Artificial Sequence
  Description of Artificial Sequence: example ZFP
RSDELRT

SEQ ID NO: 1382 - protein, 7 aa, Artificial Sequence
  Description of Artificial Sequence: example ZFP
RSDHLAR

SEQ ID NO: 1383 - protein, 7 aa, Artificial Sequence
  Description of Artificial Sequence: example ZFP
QSSNLQR

SEQ ID NO: 1384 - protein, 7 aa, Artificial Sequence
  Description of Artificial Sequence: example ZFP
QTGSLTR

SEQ ID NO: 1385 - protein, 7 aa, Artificial Sequence
  Description of Artificial Sequence: example ZFP
ERGTLTT

SEQ ID NO: 1386 - protein, 7 aa, Artificial Sequence
  Description of Artificial Sequence: example ZFP
QTGSLTR

SEQ ID NO: 1387 - protein, 7 aa, Artificial Sequence
  Description of Artificial Sequence: example ZFP
EKANLTR

SEQ ID NO: 1388 - protein, 7 aa, Artificial Sequence
  Description of Artificial Sequence: example ZFP
RSDHLAR

SEQ ID NO: 1389 - protein, 7 aa, Artificial Sequence
  Description of Artificial Sequence: example ZFP
RADTLRR

SEQ ID NO: 1390 - protein, 7 aa, Artificial Sequence
  Description of Artificial Sequence: example ZFP
RSDDLTR

SEQ ID NO: 1391 - protein, 7 aa, Artificial Sequence
  Description of Artificial Sequence: example ZFP
QSGSLTR

SEQ ID NO: 1392 - protein, 7 aa, Artificial Sequence
  Description of Artificial Sequence: example ZFP
EKANLTR

SEQ ID NO: 1393 - protein, 7 aa, Artificial Sequence
  Description of Artificial Sequence: example ZFP
RSDALRE

SEQ ID NO: 1394 - protein, 7 aa, Artificial Sequence
  Description of Artificial Sequence: example ZFP
TSGELVR

SEQ ID NO: 1395 - protein, 7 aa, Artificial Sequence
  Description of Artificial Sequence: example ZFP
QRSALAR

SEQ ID NO: 1396 - protein, 7 aa, Artificial Sequence
  Description of Artificial Sequence: example ZFP
ERGTLAR

SEQ ID NO: 1397 - protein, 7 aa, Artificial Sequence
  Description of Artificial Sequence: example ZFP
ERGTLAR

SEQ ID NO: 1398 - protein, 7 aa, Artificial Sequence
  Description of Artificial Sequence: example ZFP
QSGALTR

SEQ ID NO: 1399 - protein, 7 aa, Artificial Sequence
  Description of Artificial Sequence: example ZFP
TSGELVR

SEQ ID NO: 1400 - protein, 7 aa, Artificial Sequence
  Description of Artificial Sequence: example ZFP
RSDALRE

SEQ ID NO: 1401 - protein, 7 aa, Artificial Sequence
  Description of Artificial Sequence: example ZFP
RSDNLAR

SEQ ID NO: 1402 - protein, 7 aa, Artificial Sequence
  Description of Artificial Sequence: example ZFP
DRSSLTR

SEQ ID NO: 1403 - protein, 7 aa, Artificial Sequence
  Description of Artificial Sequence: example ZFP
QSSDLAR

SEQ ID NO: 1404 - protein, 7 aa, Artificial Sequence
  Description of Artificial Sequence: example ZFP
ERGTLAR

SEQ ID NO: 1405 - protein, 7 aa, Artificial Sequence
  Description of Artificial Sequence: example ZFP
EKANLTR

SEQ ID NO: 1406 - protein, 7 aa, Artificial Sequence
  Description of Artificial Sequence: example ZFP
QSSNLQR

SEQ ID NO: 1407 - protein, 7 aa, Artificial Sequence
  Description of Artificial Sequence: example ZFP
QSGHLAR

SEQ ID NO: 1408 - protein, 7 aa, Artificial Sequence
  Description of Artificial Sequence: example ZFP
QRSALAR

SEQ ID NO: 1409 - protein, 7 aa, Artificial Sequence
  Description of Artificial Sequence: example ZFP
RSDNLAR

SEQ ID NO: 1410 - protein, 7 aa, Artificial Sequence
  Description of Artificial Sequence: example ZFP
RSDNLAR

SEQ ID NO: 1411 - protein, 7 aa, Artificial Sequence
  Description of Artificial Sequence: example ZFP
RSDELRT

SEQ ID NO: 1412 - protein, 7 aa, Artificial Sequence
  Description of Artificial Sequence: example ZFP
RSDDLTK

SEQ ID NO: 1413 - protein, 7 aa, Artificial Sequence
  Description of Artificial Sequence: example ZFP
RSAHLAR

SEQ ID NO: 1414 - protein, 7 aa, Artificial Sequence
  Description of Artificial Sequence: example ZFP
QSSNLQR

SEQ ID NO: 1415 - protein, 7 aa, Artificial Sequence
  Description of Artificial Sequence: example ZFP
QSSHLTR

SEQ ID NO: 1416 - protein, 7 aa, Artificial Sequence
  Description of Artificial Sequence: example ZFP
QSSALTR

SEQ ID NO: 1417 - protein, 7 aa, Artificial Sequence
  Description of Artificial Sequence: example ZFP
NRATLAR

SEQ ID NO: 1418 - protein, 7 aa, Artificial Sequence
  Description of Artificial Sequence: example ZFP
RSDHLTT

SEQ ID NO: 1419 - protein, 7 aa, Artificial Sequence
  Description of Artificial Sequence: example ZFP
RSDHLTK

SEQ ID NO: 1420 - protein, 7 aa, Artificial Sequence
  Description of Artificial Sequence: example ZFP
RSDHLTT

SEQ ID NO: 1421 - protein, 7 aa, Artificial Sequence
  Description of Artificial Sequence: example ZFP
RSDHLTK

SEQ ID NO: 1422 - protein, 7 aa, Artificial Sequence
  Description of Artificial Sequence: example ZFP
QSSSLVR

SEQ ID NO: 1423 - protein, 7 aa, Artificial Sequence
  Description of Artificial Sequence: example ZFP
QSGSLTT

SEQ ID NO: 1424 - protein, 7 aa, Artificial Sequence
  Description of Artificial Sequence: example ZFP
QRSHLTT

SEQ ID NO: 1425 - protein, 7 aa, Artificial Sequence
  Description of Artificial Sequence: example ZFP
TSGHLVR

SEQ ID NO: 1426 - protein, 7 aa, Artificial Sequence
  Description of Artificial Sequence: example ZFP
NRATLAR

SEQ ID NO: 1427 - protein, 7 aa, Artificial Sequence
  Description of Artificial Sequence: example ZFP
QRSHLTT

SEQ ID NO: 1428 - protein, 7 aa, Artificial Sequence
  Description of Artificial Sequence: example ZFP
MSHHLKE

SEQ ID NO: 1429 - protein, 7 aa, Artificial Sequence
  Description of Artificial Sequence: example ZFP
MSHHLKE

SEQ ID NO: 1430 - protein, 7 aa, Artificial Sequence
  Description of Artificial Sequence: example ZFP
QSGALTR

SEQ ID NO: 1431 - protein, 7 aa, Artificial Sequence
  Description of Artificial Sequence: example ZFP
QSSDLAR

SEQ ID NO: 1432 - protein, 7 aa, Artificial Sequence
  Description of Artificial Sequence: example ZFP
RSAHLAR

SEQ ID NO: 1433 - protein, 7 aa, Artificial Sequence
  Description of Artificial Sequence: example ZFP
RSDNLAR

SEQ ID NO: 1434 - protein, 7 aa, Artificial Sequence
  Description of Artificial Sequence: example ZFP
RSDNLAR

SEQ ID NO: 1435 - protein, 7 aa, Artificial Sequence
  Description of Artificial Sequence: example ZFP
RSDNLAR

SEQ ID NO: 1436 - protein, 7 aa, Artificial Sequence
  Description of Artificial Sequence: example ZFP
RSDNLAR

SEQ ID NO: 1437 - protein, 7 aa, Artificial Sequence
  Description of Artificial Sequence: example ZFP
RSDNLTR

SEQ ID NO: 1438 - protein, 7 aa, Artificial Sequence
  Description of Artificial Sequence: example ZFP
RSDNLAR

SEQ ID NO: 1439 - protein, 7 aa, Artificial Sequence
  Description of Artificial Sequence: example ZFP
RSDALAR

SEQ ID NO: 1440 - protein, 7 aa, Artificial Sequence
  Description of Artificial Sequence: example ZFP
RSDNLAR

SEQ ID NO: 1441 - protein, 7 aa, Artificial Sequence
  Description of Artificial Sequence: example ZFP
RSDNLAR

SEQ ID NO: 1442 - protein, 7 aa, Artificial Sequence
  Description of Artificial Sequence: example ZFP
TSGNLVR

SEQ ID NO: 1443 - protein, 7 aa, Artificial Sequence
  Description of Artificial Sequence: example ZFP
QRAHLER

SEQ ID NO: 1444 - protein, 7 aa, Artificial Sequence
  Description of Artificial Sequence: example ZFP
QSGHLQR

SEQ ID NO: 1445 - protein, 7 aa, Artificial Sequence
  Description of Artificial Sequence: example ZFP
RSDALAR

SEQ ID NO: 1446 - protein, 7 aa, Artificial Sequence
  Description of Artificial Sequence: example ZFP
RSDALSR

SEQ ID NO: 1447 - protein, 7 aa, Artificial Sequence
  Description of Artificial Sequence: example ZFP
QQSNLVR

SEQ ID NO: 1448 - protein, 7 aa, Artificial Sequence
  Description of Artificial Sequence: example ZFP
RSDALSR

SEQ ID NO: 1449 - protein, 7 aa, Artificial Sequence
  Description of Artificial Sequence: example ZFP
ERGHLTR

SEQ ID NO: 1450 - protein, 7 aa, Artificial Sequence
  Description of Artificial Sequence: example ZFP
QSSDLTR

SEQ ID NO: 1451 - protein, 7 aa, Artificial Sequence
  Description of Artificial Sequence: example ZFP
RSDNLAR

SEQ ID NO: 1452 - protein, 7 aa, Artificial Sequence
  Description of Artificial Sequence: example ZFP
RSDALSR

SEQ ID NO: 1453 - protein, 7 aa, Artificial Sequence
  Description of Artificial Sequence: example ZFP
RSDALSR

SEQ ID NO: 1454 - protein, 7 aa, Artificial Sequence
  Description of Artificial Sequence: example ZFP
DRSNLTR

SEQ ID NO: 1455 - protein, 7 aa, Artificial Sequence
  Description of Artificial Sequence: example ZFP
RSDNLAR

SEQ ID NO: 1456 - protein, 7 aa, Artificial Sequence
  Description of Artificial Sequence: example ZFP
RADTLRR

SEQ ID NO: 1457 - protein, 7 aa, Artificial Sequence
  Description of Artificial Sequence: example ZFP
DRSSLTR

SEQ ID NO: 1458 - protein, 7 aa, Artificial Sequence
  Description of Artificial Sequence: example ZFP
RSDHLTT

SEQ ID NO: 1459 - protein, 7 aa, Artificial Sequence
  Description of Artificial Sequence: example ZFP
QSSHLAR

SEQ ID NO: 1460 - protein, 7 aa, Artificial Sequence
  Description of Artificial Sequence: example ZFP
RSDNLAR

SEQ ID NO: 1461 - protein, 7 aa, Artificial Sequence
  Description of Artificial Sequence: example ZFP
RSDELQR

SEQ ID NO: 1462 - protein, 7 aa, Artificial Sequence
  Description of Artificial Sequence: example ZFP
RSDELRT

SEQ ID NO: 1463 - protein, 7 aa, Artificial Sequence
  Description of Artificial Sequence: example ZFP
RSDELQR

SEQ ID NO: 1464 - protein, 7 aa, Artificial Sequence
  Description of Artificial Sequence: example ZFP
DRSNLTR

SEQ ID NO: 1465 - protein, 7 aa, Artificial Sequence
  Description of Artificial Sequence: example ZFP
RRDVLMN

SEQ ID NO: 1466 - protein, 7 aa, Artificial Sequence
  Description of Artificial Sequence: example ZFP
RSDDLNR

SEQ ID NO: 1467 - protein, 7 aa, Artificial Sequence
  Description of Artificial Sequence: example ZFP
RSDNLAR

SEQ ID NO: 1468 - protein, 7 aa, Artificial Sequence
  Description of Artificial Sequence: example ZFP
QSGDLTR

SEQ ID NO: 1469 - protein, 7 aa, Artificial Sequence
  Description of Artificial Sequence: example ZFP
RSDALRQ

SEQ ID NO: 1470 - protein, 7 aa, Artificial Sequence
  Description of Artificial Sequence: example ZFP
RSDELQR

SEQ ID NO: 1471 - protein, 7 aa, Artificial Sequence
  Description of Artificial Sequence: example ZFP
RSDHLSR

SEQ ID NO: 1472 - protein, 7 aa, Artificial Sequence
  Description of Artificial Sequence: example ZFP
RADTLRR

SEQ ID NO: 1473 - protein, 7 aa, Artificial Sequence
  Description of Artificial Sequence: example ZFP
RSDNLTK

SEQ ID NO: 1474 - protein, 7 aa, Artificial Sequence
  Description of Artificial Sequence: example ZFP
QSGSLTR

SEQ ID NO: 1475 - protein, 7 aa, Artificial Sequence
  Description of Artificial Sequence: example ZFP
QSGHLTR

SEQ ID NO: 1476 - protein, 7 aa, Artificial Sequence
  Description of Artificial Sequence: example ZFP
QSGHLTR

SEQ ID NO: 1477 - protein, 7 aa, Artificial Sequence
  Description of Artificial Sequence: example ZFP
RSDHLTT

SEQ ID NO: 1478 - protein, 7 aa, Artificial Sequence
  Description of Artificial Sequence: example ZFP
RSDHLTT

SEQ ID NO: 1479 - protein, 7 aa, Artificial Sequence
  Description of Artificial Sequence: example ZFP
DRSSLTR

SEQ ID NO: 1480 - protein, 7 aa, Artificial Sequence
  Description of Artificial Sequence: example ZFP
RSDNLAR

SEQ ID NO: 1481 - protein, 7 aa, Artificial Sequence
  Description of Artificial Sequence: example ZFP
RSDELQR

SEQ ID NO: 1482 - protein, 7 aa, Artificial Sequence
  Description of Artificial Sequence: example ZFP
RSDNLAR

SEQ ID NO: 1483 - protein, 7 aa, Artificial Sequence
  Description of Artificial Sequence: example ZFP
RSDNLAR

SEQ ID NO: 1484 - protein, 7 aa, Artificial Sequence
  Description of Artificial Sequence: example ZFP
RSDELQR

SEQ ID NO: 1485 - protein, 7 aa, Artificial Sequence
  Description of Artificial Sequence: example ZFP
RSDNLAR

SEQ ID NO: 1486 - protein, 7 aa, Artificial Sequence
  Description of Artificial Sequence: example ZFP
DRSSLTR

SEQ ID NO: 1487 - protein, 7 aa, Artificial Sequence
  Description of Artificial Sequence: example ZFP
QSSHLAS

SEQ ID NO: 1488 - protein, 7 aa, Artificial Sequence
  Description of Artificial Sequence: example ZFP
QSGSLTR

SEQ ID NO: 1489 - protein, 7 aa, Artificial Sequence
  Description of Artificial Sequence: example ZFP
QSGHLQR

SEQ ID NO: 1490 - protein, 7 aa, Artificial Sequence
  Description of Artificial Sequence: example ZFP
QSGSLTR

SEQ ID NO: 1491 - protein, 7 aa, Artificial Sequence
  Description of Artificial Sequence: example ZFP
RSDNLTT

SEQ ID NO: 1492 - protein, 7 aa, Artificial Sequence
  Description of Artificial Sequence: example ZFP
RSDALRQ

SEQ ID NO: 1493 - protein, 7 aa, Artificial Sequence
  Description of Artificial Sequence: example ZFP
QSGSLTR

SEQ ID NO: 1494 - protein, 7 aa, Artificial Sequence
  Description of Artificial Sequence: example ZFP
RSDELQR

SEQ ID NO: 1495 - protein, 7 aa, Artificial Sequence
  Description of Artificial Sequence: example ZFP
TSDHLAS

SEQ ID NO: 1496 - protein, 7 aa, Artificial Sequence
  Description of Artificial Sequence: example ZFP
MSHHLKT

SEQ ID NO: 1497 - protein, 7 aa, Artificial Sequence
  Description of Artificial Sequence: example ZFP
RSDNLAR

SEQ ID NO: 1498 - protein, 7 aa, Artificial Sequence
  Description of Artificial Sequence: example ZFP
RSDNLAR

SEQ ID NO: 1499 - protein, 7 aa, Artificial Sequence
  Description of Artificial Sequence: example ZFP
QSGSLTR

SEQ ID NO: 1500 - protein, 7 aa, Artificial Sequence
  Description of Artificial Sequence: example ZFP
RRDVLMN

SEQ ID NO: 1501 - protein, 7 aa, Artificial Sequence
  Description of Artificial Sequence: example ZFP
RSDNLTT

SEQ ID NO: 1502 - protein, 7 aa, Artificial Sequence
  Description of Artificial Sequence: example ZFP
QRSALAR

SEQ ID NO: 1503 - protein, 7 aa, Artificial Sequence
  Description of Artificial Sequence: example ZFP
QRSALAR

SEQ ID NO: 1504 - protein, 7 aa, Artificial Sequence
  Description of Artificial Sequence: example ZFP
ERQHLAT

SEQ ID NO: 1505 - protein, 7 aa, Artificial Sequence
  Description of Artificial Sequence: example ZFP
ERQHLAT

SEQ ID NO: 1506 - protein, 7 aa, Artificial Sequence
  Description of Artificial Sequence: example ZFP
DRSHLRT

SEQ ID NO: 1507 - protein, 7 aa, Artificial Sequence
  Description of Artificial Sequence: example ZFP
DRSHLRT

SEQ ID NO: 1508 - protein, 7 aa, Artificial Sequence
  Description of Artificial Sequence: example ZFP
RSDALSR

SEQ ID NO: 1509 - protein, 7 aa, Artificial Sequence
  Description of Artificial Sequence: example ZFP
QQSNLVR

SEQ ID NO: 1510 - protein, 7 aa, Artificial Sequence
  Description of Artificial Sequence: example ZFP
QRSALAR

SEQ ID NO: 1511 - protein, 7 aa, Artificial Sequence
  Description of Artificial Sequence: example ZFP
RSDNLTT

SEQ ID NO: 1512 - protein, 7 aa, Artificial Sequence
  Description of Artificial Sequence: example ZFP
QSSSLVR

SEQ ID NO: 1513 - protein, 7 aa, Artificial Sequence
  Description of Artificial Sequence: example ZFP
QSSSLVR

SEQ ID NO: 1514 - protein, 7 aa, Artificial Sequence
  Description of Artificial Sequence: example ZFP
QSSSLVR

SEQ ID NO: 1515 - protein, 7 aa, Artificial Sequence
  Description of Artificial Sequence: example ZFP
QRSALAR

SEQ ID NO: 1516 - protein, 7 aa, Artificial Sequence
  Description of Artificial Sequence: example ZFP
RSDELQR

SEQ ID NO: 1517 - protein, 7 aa, Artificial Sequence
  Description of Artificial Sequence: example ZFP
QRAHLER

SEQ ID NO: 1518 - protein, 7 aa, Artificial Sequence
  Description of Artificial Sequence: example ZFP
QSGDLTR

SEQ ID NO: 1519 - protein, 7 aa, Artificial Sequence
  Description of Artificial Sequence: example ZFP
RSDNLVR

SEQ ID NO: 1520 - protein, 7 aa, Artificial Sequence
  Description of Artificial Sequence: example ZFP
RSDERKR

SEQ ID NO: 1521 - protein, 7 aa, Artificial Sequence
  Description of Artificial Sequence: example ZFP
RSDNLVR

SEQ ID NO: 1522 - protein, 7 aa, Artificial Sequence
  Description of Artificial Sequence: example ZFP
RSDNLAR

SEQ ID NO: 1523 - protein, 7 aa, Artificial Sequence
  Description of Artificial Sequence: example ZFP
RSDTLKK

SEQ ID NO: 1524 - protein, 7 aa, Artificial Sequence
  Description of Artificial Sequence: example ZFP
RSDTLKK

SEQ ID NO: 1525 - protein, 7 aa, Artificial Sequence
  Description of Artificial Sequence: example ZFP
DRSNLTR

SEQ ID NO: 1526 - protein, 7 aa, Artificial Sequence
  Description of Artificial Sequence: example ZFP
RSDNLTQ

SEQ ID NO: 1527 - protein, 7 aa, Artificial Sequence
  Description of Artificial Sequence: example ZFP
RSDALAR

SEQ ID NO: 1528 - protein, 7 aa, Artificial Sequence
  Description of Artificial Sequence: example ZFP
RSDALTQ

SEQ ID NO: 1529 - protein, 7 aa, Artificial Sequence
  Description of Artificial Sequence: example ZFP
RSDHLSR

SEQ ID NO: 1530 - protein, 7 aa, Artificial Sequence
  Description of Artificial Sequence: example ZFP
RSDHLSR

SEQ ID NO: 1531 - protein, 7 aa, Artificial Sequence
  Description of Artificial Sequence: example ZFP
RSDNLAR

SEQ ID NO: 1532 - protein, 7 aa, Artificial Sequence
  Description of Artificial Sequence: example ZFP
QSHDLTK

SEQ ID NO: 1533 - protein, 7 aa, Artificial Sequence
  Description of Artificial Sequence: example ZFP
RSDALTQ

SEQ ID NO: 1534 - protein, 7 aa, Artificial Sequence
  Description of Artificial Sequence: example ZFP
QSHDLTK

SEQ ID NO: 1535 - protein, 7 aa, Artificial Sequence
  Description of Artificial Sequence: example ZFP
RSDDLRR

SEQ ID NO: 1536 - protein, 7 aa, Artificial Sequence
  Description of Artificial Sequence: example ZFP
RSDNLRE

SEQ ID NO: 1537 - protein, 7 aa, Artificial Sequence
  Description of Artificial Sequence: example ZFP
QSGDLTR

SEQ ID NO: 1538 - protein, 7 aa, Artificial Sequence
  Description of Artificial Sequence: example ZFP
QSGSLRT

SEQ ID NO: 1539 - protein, 7 aa, Artificial Sequence
  Description of Artificial Sequence: example ZFP
QSGDLRT

SEQ ID NO: 1540 - protein, 7 aa, Artificial Sequence
  Description of Artificial Sequence: example ZFP
RSDELRT

SEQ ID NO: 1541 - protein, 7 aa, Artificial Sequence
  Description of Artificial Sequence: example ZFP
RSDHLSR

SEQ ID NO: 1542 - protein, 7 aa, Artificial Sequence
  Description of Artificial Sequence: example ZFP
RSDTLKK

SEQ ID NO: 1543 - protein, 7 aa, Artificial Sequence
  Description of Artificial Sequence: example ZFP
RSDHLTQ

SEQ ID NO: 1544 - protein, 7 aa, Artificial Sequence
  Description of Artificial Sequence: example ZFP
QSGNLTR

SEQ ID NO: 1545 - protein, 7 aa, Artificial Sequence
  Description of Artificial Sequence: example ZFP
RSDTLKK

SEQ ID NO: 1546 - protein, 7 aa, Artificial Sequence
  Description of Artificial Sequence: example ZFP
RSDHLSR

SEQ ID NO: 1547 - protein, 7 aa, Artificial Sequence
  Description of Artificial Sequence: example ZFP
QSGHLNQ

SEQ ID NO: 1548 - protein, 7 aa, Artificial Sequence
  Description of Artificial Sequence: example ZFP
RSDNLAR

SEQ ID NO: 1549 - protein, 7 aa, Artificial Sequence
  Description of Artificial Sequence: example ZFP
QSGSLTR

SEQ ID NO: 1550 - protein, 7 aa, Artificial Sequence
  Description of Artificial Sequence: example ZFP
RSDELRT

SEQ ID NO: 1551 - protein, 7 aa, Artificial Sequence
  Description of Artificial Sequence: example ZFP
RLHNLQR

SEQ ID NO: 1552 - protein, 7 aa, Artificial Sequence
  Description of Artificial Sequence: example ZFP
QSGSLTR

SEQ ID NO: 1553 - protein, 7 aa, Artificial Sequence
  Description of Artificial Sequence: example ZFP
DRSNLTR

SEQ ID NO: 1554 - protein, 7 aa, Artificial Sequence
  Description of Artificial Sequence: example ZFP
QSSDLSR

SEQ ID NO: 1555 - protein, 7 aa, Artificial Sequence
  Description of Artificial Sequence: example ZFP
RLHNLQR

SEQ ID NO: 1556 - protein, 7 aa, Artificial Sequence
  Description of Artificial Sequence: example ZFP
KNWKLQA

SEQ ID NO: 1557 - protein, 7 aa, Artificial Sequence
  Description of Artificial Sequence: example ZFP
RSDDLRR

SEQ ID NO: 1558 - protein, 7 aa, Artificial Sequence
  Description of Artificial Sequence: example ZFP
ASSRLAT

SEQ ID NO: 1559 - protein, 7 aa, Artificial Sequence
  Description of Artificial Sequence: example ZFP
DRSNLTR

SEQ ID NO: 1560 - protein, 7 aa, Artificial Sequence
  Description of Artificial Sequence: example ZFP
QSSDLSR

SEQ ID NO: 1561 - protein, 7 aa, Artificial Sequence
  Description of Artificial Sequence: example ZFP
RSDNLTT

SEQ ID NO: 1562 - protein, 7 aa, Artificial Sequence
  Description of Artificial Sequence: example ZFP
RSDNLTT

SEQ ID NO: 1563 - protein, 7 aa, Artificial Sequence
  Description of Artificial Sequence: example ZFP
QSSNLVR

SEQ ID NO: 1564 - protein, 7 aa, Artificial Sequence
  Description of Artificial Sequence: example ZFP
DRSNLTR

SEQ ID NO: 1565 - protein, 7 aa, Artificial Sequence
  Description of Artificial Sequence: example ZFP
RSDHLSR

SEQ ID NO: 1566 - protein, 7 aa, Artificial Sequence
  Description of Artificial Sequence: example ZFP
QSGDLTR

SEQ ID NO: 1567 - protein, 7 aa, Artificial Sequence
  Description of Artificial Sequence: example ZFP
QSGDLTR

SEQ ID NO: 1568 - protein, 7 aa, Artificial Sequence
  Description of Artificial Sequence: example ZFP
ERGTLAR

SEQ ID NO: 1569 - protein, 7 aa, Artificial Sequence
  Description of Artificial Sequence: example ZFP
DRSDLTR

SEQ ID NO: 1570 - protein, 7 aa, Artificial Sequence
  Description of Artificial Sequence: example ZFP
QSGDLTR

SEQ ID NO: 1571 - protein, 7 aa, Artificial Sequence
  Description of Artificial Sequence: example ZFP
QSGSLTR

SEQ ID NO: 1572 - protein, 7 aa, Artificial Sequence
  Description of Artificial Sequence: example ZFP
RSDHLTA

SEQ ID NO: 1573 - protein, 7 aa, Artificial Sequence
  Description of Artificial Sequence: example ZFP
RSDNLAR

SEQ ID NO: 1574 - protein, 7 aa, Artificial Sequence
  Description of Artificial Sequence: example ZFP
RSDSLTK

SEQ ID NO: 1575 - protein, 7 aa, Artificial Sequence
  Description of Artificial Sequence: example ZFP
RSDHLSR

SEQ ID NO: 1576 - protein, 7 aa, Artificial Sequence
  Description of Artificial Sequence: example ZFP
RSDSLTK

SEQ ID NO: 1577 - protein, 7 aa, Artificial Sequence
  Description of Artificial Sequence: example ZFP
DRSNLTR

SEQ ID NO: 1578 - protein, 7 aa, Artificial Sequence
  Description of Artificial Sequence: example ZFP
RSDNLQR

SEQ ID NO: 1579 - protein, 7 aa, Artificial Sequence
  Description of Artificial Sequence: example ZFP
QSSDLSR

SEQ ID NO: 1580 - protein, 7 aa, Artificial Sequence
  Description of Artificial Sequence: example ZFP
QSGSLTR

SEQ ID NO: 1581 - protein, 7 aa, Artificial Sequence
  Description of Artificial Sequence: example ZFP
RSDNLAR

SEQ ID NO: 1582 - protein, 7 aa, Artificial Sequence
  Description of Artificial Sequence: example ZFP
RSDNLAR

SEQ ID NO: 1583 - protein, 7 aa, Artificial Sequence
  Description of Artificial Sequence: example ZFP
QRAHLAR

SEQ ID NO: 1584 - protein, 7 aa, Artificial Sequence
  Description of Artificial Sequence: example ZFP
QRAHLAR

SEQ ID NO: 1585 - protein, 7 aa, Artificial Sequence
  Description of Artificial Sequence: example ZFP
QSSDLSR

SEQ ID NO: 1586 - protein, 7 aa, Artificial Sequence
  Description of Artificial Sequence: example ZFP
RSDNLQR

SEQ ID NO: 1587 - protein, 7 aa, Artificial Sequence
  Description of Artificial Sequence: example ZFP
RSDNLTQ

SEQ ID NO: 1588 - protein, 7 aa, Artificial Sequence
  Description of Artificial Sequence: example ZFP
RSDTLTQ

SEQ ID NO: 1589 - protein, 7 aa, Artificial Sequence
  Description of Artificial Sequence: example ZFP
RSDTLTQ

SEQ ID NO: 1590 - protein, 7 aa, Artificial Sequence
  Description of Artificial Sequence: example ZFP
RSDALAR

SEQ ID NO: 1591 - protein, 7 aa, Artificial Sequence
  Description of Artificial Sequence: example ZFP
RSDALAR

SEQ ID NO: 1592 - protein, 7 aa, Artificial Sequence
  Description of Artificial Sequence: example ZFP
RSDALAR

SEQ ID NO: 1593 - protein, 7 aa, Artificial Sequence
  Description of Artificial Sequence: example ZFP
RSDALAR

SEQ ID NO: 1594 - protein, 7 aa, Artificial Sequence
  Description of Artificial Sequence: example ZFP
QSGDLRT

SEQ ID NO: 1595 - protein, 7 aa, Artificial Sequence
  Description of Artificial Sequence: example ZFP
RSDALTQ

SEQ ID NO: 1596 - protein, 7 aa, Artificial Sequence
  Description of Artificial Sequence: example ZFP
RSDALRE

SEQ ID NO: 1597 - protein, 7 aa, Artificial Sequence
  Description of Artificial Sequence: example ZFP
RSDNLTQ

SEQ ID NO: 1598 - protein, 7 aa, Artificial Sequence
  Description of Artificial Sequence: example ZFP
RSDTLTQ

SEQ ID NO: 1599 - protein, 7 aa, Artificial Sequence
  Description of Artificial Sequence: example ZFP
RSDALRE

SEQ ID NO: 1600 - protein, 7 aa, Artificial Sequence
  Description of Artificial Sequence: example ZFP
RSDALRE

SEQ ID NO: 1601 - protein, 7 aa, Artificial Sequence
  Description of Artificial Sequence: example ZFP
RSDALRE

SEQ ID NO: 1602 - protein, 7 aa, Artificial Sequence
  Description of Artificial Sequence: example ZFP
QSGSLTR

SEQ ID NO: 1603 - protein, 7 aa, Artificial Sequence
  Description of Artificial Sequence: example ZFP
RSDHLSR

SEQ ID NO: 1604 - protein, 7 aa, Artificial Sequence
  Description of Artificial Sequence: example ZFP
QSSDLSR

SEQ ID NO: 1605 - DNA, 10 bp, Artificial Sequence
  Description of Artificial Sequence: example target DNA
aaggtggcag

SEQ ID NO: 1606 - DNA, 10 bp, Artificial Sequence
  Description of Artificial Sequence: example target DNA
ttggctgggc

SEQ ID NO: 1607 - DNA, 10 bp, Artificial Sequence
  Description of Artificial Sequence: example target DNA
gtggctgcag

SEQ ID NO: 1608 - DNA, 10 bp, Artificial Sequence
  Description of Artificial Sequence: example target DNA
gtggctgcag

SEQ ID NO: 1609 - DNA, 10 bp, Artificial Sequence
  Description of Artificial Sequence: example target DNA
ttggctgggc

SEQ ID NO: 1610 - DNA, 10 bp, Artificial Sequence
  Description of Artificial Sequence: example target DNA
ttggctgggc

SEQ ID NO: 1611 - DNA, 10 bp, Artificial Sequence
  Description of Artificial Sequence: example target DNA
gaggaggatg

SEQ ID NO: 1612 - DNA, 9 bp, Artificial Sequence
  Description of Artificial Sequence: example target DNA
aaggggggg

SEQ ID NO: 1613 - DNA, 9 bp, Artificial Sequence
  Description of Artificial Sequence: example target DNA
aaggggggg

SEQ ID NO: 1614 - DNA, 9 bp, Artificial Sequence
  Description of Artificial Sequence: example target DNA
aaggggggg

SEQ ID NO: 1615 - DNA, 9 bp, Artificial Sequence
  Description of Artificial Sequence: example target DNA
aaggggggg

SEQ ID NO: 1616 - DNA, 9 bp, Artificial Sequence
  Description of Artificial Sequence: example target DNA
aaggggggg

SEQ ID NO: 1617 - DNA, 10 bp, Artificial Sequence
  Description of Artificial Sequence: example target DNA
acggatgtct

SEQ ID NO: 1618 - DNA, 10 bp, Artificial Sequence
  Description of Artificial Sequence: example target DNA
ttgtagggga

SEQ ID NO: 1619 - DNA, 10 bp, Artificial Sequence
  Description of Artificial Sequence: example target DNA
ttgtagggga

SEQ ID NO: 1620 - DNA, 10 bp, Artificial Sequence
  Description of Artificial Sequence: example target DNA
cggggagagt

SEQ ID NO: 1621 - DNA, 10 bp, Artificial Sequence
  Description of Artificial Sequence: example target DNA
ttggtggaag

SEQ ID NO: 1622 - DNA, 10 bp, Artificial Sequence
  Description of Artificial Sequence: example target DNA
ttggtggaag

SEQ ID NO: 1623 - DNA, 10 bp, Artificial Sequence
  Description of Artificial Sequence: example target DNA
gttgtggaat

SEQ ID NO: 1624 - DNA, 10 bp, Artificial Sequence
  Description of Artificial Sequence: example target DNA
taggaggctg

SEQ ID NO: 1625 - DNA, 10 bp, Artificial Sequence
  Description of Artificial Sequence: example target DNA
taggaggctg

SEQ ID NO: 1626 - DNA, 10 bp, Artificial Sequence
  Description of Artificial Sequence: example target DNA
taggcataaa

SEQ ID NO: 1627 - DNA, 10 bp, Artificial Sequence
  Description of Artificial Sequence: example target DNA
taggcataaa

SEQ ID NO: 1628 - DNA, 10 bp, Artificial Sequence
  Description of Artificial Sequence: example target DNA
taggcataaa

SEQ ID NO: 1629 - DNA, 10 bp, Artificial Sequence
  Description of Artificial Sequence: example target DNA
taggcataaa

SEQ ID NO: 1630 - DNA, 10 bp, Artificial Sequence
  Description of Artificial Sequence: example target DNA
gagggagttc

SEQ ID NO: 1631 - DNA, 10 bp, Artificial Sequence
  Description of Artificial Sequence: example target DNA
gagggagttc

SEQ ID NO: 1632 - DNA, 10 bp, Artificial Sequence
  Description of Artificial Sequence: example target DNA
gcggaggcgc

SEQ ID NO: 1633 - DNA, 10 bp, Artificial Sequence
  Description of Artificial Sequence: example target DNA
aaggcggaga

SEQ ID NO: 1634 - DNA, 10 bp, Artificial Sequence
  Description of Artificial Sequence: example target DNA
aaggcggaga

SEQ ID NO: 1635 - DNA, 10 bp, Artificial Sequence
  Description of Artificial Sequence: example target DNA
aaggcggaga

SEQ ID NO: 1636 - DNA, 10 bp, Artificial Sequence
  Description of Artificial Sequence: example target DNA
aaggcggaga

SEQ ID NO: 1637 - DNA, 10 bp, Artificial Sequence
  Description of Artificial Sequence: example target DNA
gggggcgagc

SEQ ID NO: 1638 - DNA, 10 bp, Artificial Sequence
  Description of Artificial Sequence: example target DNA
tgagcggcgg

SEQ ID NO: 1639 - DNA, 10 bp, Artificial Sequence
  Description of Artificial Sequence: example target DNA
tgagcggcgg

SEQ ID NO: 1640 - DNA, 10 bp, Artificial Sequence
  Description of Artificial Sequence: example target DNA
gcggcggcag

SEQ ID NO: 1641 - DNA, 10 bp, Artificial Sequence
  Description of Artificial Sequence: example target DNA
gcggcggcag

SEQ ID NO: 1642 - DNA, 10 bp, Artificial Sequence
  Description of Artificial Sequence: example target DNA
gcagcggagc

SEQ ID NO: 1643 - DNA, 10 bp, Artificial Sequence
  Description of Artificial Sequence: example target DNA
gcagcggagc

SEQ ID NO: 1644 - DNA, 10 bp, Artificial Sequence
  Description of Artificial Sequence: example target DNA
aaggtggcag

SEQ ID NO: 1645 - DNA, 10 bp, Artificial Sequence
  Description of Artificial Sequence: example target DNA
ggggtggggc

SEQ ID NO: 1646 - DNA, 10 bp, Artificial Sequence
  Description of Artificial Sequence: example target DNA
ggggtggggc

SEQ ID NO: 1647 - DNA, 9 bp, Artificial Sequence
  Description of Artificial Sequence: example target DNA
gagtcggaa

SEQ ID NO: 1648 - DNA, 9 bp, Artificial Sequence
  Description of Artificial Sequence: example target DNA
gagtcggaa

SEQ ID NO: 1649 - DNA, 9 bp, Artificial Sequence
  Description of Artificial Sequence: example target DNA
gagtcggaa

SEQ ID NO: 1650 - DNA, 9 bp, Artificial Sequence
  Description of Artificial Sequence: example target DNA
gagtcggaa

SEQ ID NO: 1651 - DNA, 10 bp, Artificial Sequence
  Description of Artificial Sequence: example target DNA
ggtgaggagt

SEQ ID NO: 1652 - DNA, 10 bp, Artificial Sequence
  Description of Artificial Sequence: example target DNA
ggtgaggagt

SEQ ID NO: 1653 - DNA, 10 bp, Artificial Sequence
  Description of Artificial Sequence: example target DNA
tgggtcgcgg

SEQ ID NO: 1654 - DNA, 10 bp, Artificial Sequence
  Description of Artificial Sequence: example target DNA
tgggtcgcgg

SEQ ID NO: 1655 - DNA, 10 bp, Artificial Sequence
  Description of Artificial Sequence: example target DNA
ttgggagcac

SEQ ID NO: 1656 - DNA, 10 bp, Artificial Sequence
  Description of Artificial Sequence: example target DNA
ttgggagcac

SEQ ID NO: 1657 - DNA, 10 bp, Artificial Sequence
  Description of Artificial Sequence: example target DNA
ttgggagcac

SEQ ID NO: 1658 - DNA, 10 bp, Artificial Sequence
  Description of Artificial Sequence: example target DNA
ggcatggtgg

SEQ ID NO: 1659 - DNA, 10 bp, Artificial Sequence
  Description of Artificial Sequence: example target DNA
gaagaggatg

SEQ ID NO: 1660 - DNA, 10 bp, Artificial Sequence
  Description of Artificial Sequence: example target DNA
atgggggtgg

SEQ ID NO: 1661 - DNA, 10 bp, Artificial Sequence
  Description of Artificial Sequence: example target DNA
ggcatggtgg

SEQ ID NO: 1662 - DNA, 10 bp, Artificial Sequence
  Description of Artificial Sequence: example target DNA
gcttgagtta

SEQ ID NO: 1663 - DNA, 10 bp, Artificial Sequence
  Description of Artificial Sequence: example target DNA
gaagaggatg

SEQ ID NO: 1664 - DNA, 10 bp, Artificial Sequence
  Description of Artificial Sequence: example target DNA
gcggtggctc

SEQ ID NO: 1665 - DNA, 10 bp, Artificial Sequence
  Description of Artificial Sequence: example target DNA
ggtgaggagt

SEQ ID NO: 1666 - DNA, 10 bp, Artificial Sequence
  Description of Artificial Sequence: example target DNA
ggaggggagt

SEQ ID NO: 1667 - DNA, 10 bp, Artificial Sequence
  Description of Artificial Sequence: example target DNA
tgggtcgcgg

SEQ ID NO: 1668 - DNA, 10 bp, Artificial Sequence
  Description of Artificial Sequence: example target DNA
gtgggggaga

SEQ ID NO: 1669 - DNA, 10 bp, Artificial Sequence
  Description of Artificial Sequence: example target DNA
gcgggtgggg

SEQ ID NO: 1670 - DNA, 10 bp, Artificial Sequence
  Description of Artificial Sequence: example target DNA
gcgggtgggg

SEQ ID NO: 1671 - DNA, 10 bp, Artificial Sequence
  Description of Artificial Sequence: example target DNA
ggggctgggt

SEQ ID NO: 1672 - DNA, 10 bp, Artificial Sequence
  Description of Artificial Sequence: example target DNA
gcggtggctc

SEQ ID NO: 1673 - DNA, 10 bp, Artificial Sequence
  Description of Artificial Sequence: example target DNA
gaggtgggga

SEQ ID NO: 1674 - DNA, 10 bp, Artificial Sequence
  Description of Artificial Sequence: example target DNA
ggaggggagt

SEQ ID NO: 1675 - DNA, 10 bp, Artificial Sequence
  Description of Artificial Sequence: example target DNA
aaggtggcag

SEQ ID NO: 1676 - DNA, 10 bp, Artificial Sequence
  Description of Artificial Sequence: example target DNA
aaggctgaga

SEQ ID NO: 1677 - DNA, 10 bp, Artificial Sequence
  Description of Artificial Sequence: example target DNA
acggggttat

SEQ ID NO: 1678 - DNA, 10 bp, Artificial Sequence
  Description of Artificial Sequence: example target DNA
acggggttat

SEQ ID NO: 1679 - DNA, 10 bp, Artificial Sequence
  Description of Artificial Sequence: example target DNA
acggggttat

SEQ ID NO: 1680 - DNA, 10 bp, Artificial Sequence
  Description of Artificial Sequence: example target DNA
acggggttat

SEQ ID NO: 1681 - DNA, 10 bp, Artificial Sequence
  Description of Artificial Sequence: example target DNA
ctggaagcat

SEQ ID NO: 1682 - DNA, 10 bp, Artificial Sequence
  Description of Artificial Sequence: example target DNA
ctattttggg

SEQ ID NO: 1683 - DNA, 10 bp, Artificial Sequence
  Description of Artificial Sequence: example target DNA
ttggacggcg

SEQ ID NO: 1684 - DNA, 10 bp, Artificial Sequence
  Description of Artificial Sequence: example target DNA
ttggacggcg

SEQ ID NO: 1685 - DNA, 10 bp, Artificial Sequence
  Description of Artificial Sequence: example target DNA
gagggagcga

SEQ ID NO: 1686 - DNA, 10 bp, Artificial Sequence
  Description of Artificial Sequence: example target DNA
ggtgaggagt

SEQ ID NO: 1687 - DNA, 10 bp, Artificial Sequence
  Description of Artificial Sequence: example target DNA
gaggtgggga

SEQ ID NO: 1688 - DNA, 10 bp, Artificial Sequence
  Description of Artificial Sequence: example target DNA
cgggcggctg

SEQ ID NO: 1689 - DNA, 10 bp, Artificial Sequence
  Description of Artificial Sequence: example target DNA
cgggcggctg

SEQ ID NO: 1690 - DNA, 10 bp, Artificial Sequence
  Description of Artificial Sequence: example target DNA
ttggacggcg

SEQ ID NO: 1691 - DNA, 10 bp, Artificial Sequence
  Description of Artificial Sequence: example target DNA
ttggacggcg

SEQ ID NO: 1692 - DNA, 10 bp, Artificial Sequence
  Description of Artificial Sequence: example target DNA
gcggtggctc

SEQ ID NO: 1693 - DNA, 10 bp, Artificial Sequence
  Description of Artificial Sequence: example target DNA
gcggtggctc

SEQ ID NO: 1694 - DNA, 10 bp, Artificial Sequence
  Description of Artificial Sequence: example target DNA
atggacgggt

SEQ ID NO: 1695 - DNA, 10 bp, Artificial Sequence
  Description of Artificial Sequence: example target DNA
atggacgggt

SEQ ID NO: 1696 - DNA, 10 bp, Artificial Sequence
  Description of Artificial Sequence: example target DNA
cggggagcag

SEQ ID NO: 1697 - DNA, 10 bp, Artificial Sequence
  Description of Artificial Sequence: example target DNA
cggggagcag

SEQ ID NO: 1698 - DNA, 10 bp, Artificial Sequence
  Description of Artificial Sequence: example target DNA
ggggagcagc

SEQ ID NO: 1699 - DNA, 10 bp, Artificial Sequence
  Description of Artificial Sequence: example target DNA
ttgggagcgg

SEQ ID NO: 1700 - DNA, 10 bp, Artificial Sequence
  Description of Artificial Sequence: example target DNA
ttgggagcgg

SEQ ID NO: 1701 - DNA, 10 bp, Artificial Sequence
  Description of Artificial Sequence: example target DNA
ttgggagcgg

SEQ ID NO: 1702 - DNA, 10 bp, Artificial Sequence
  Description of Artificial Sequence: example target DNA
agggaggatg

SEQ ID NO: 1703 - DNA, 10 bp, Artificial Sequence
  Description of Artificial Sequence: example target DNA
gagggagcga

SEQ ID NO: 1704 - DNA, 10 bp, Artificial Sequence
  Description of Artificial Sequence: example target DNA
gagggagcga

SEQ ID NO: 1705 - DNA, 10 bp, Artificial Sequence
  Description of Artificial Sequence: example target DNA
gcgtgggcgt

SEQ ID NO: 1706 - DNA, 10 bp, Artificial Sequence
  Description of Artificial Sequence: example target DNA
gcgtgggcgt

SEQ ID NO: 1707 - protein, 7 aa, Artificial Sequence
  Description of Artificial Sequence: example ZFP
QSGDLTR

SEQ ID NO: 1708 - protein, 7 aa, Artificial Sequence
  Description of Artificial Sequence: example ZFP
GSWHLTR

SEQ ID NO: 1709 - protein, 7 aa, Artificial Sequence
  Description of Artificial Sequence: example ZFP
QSGDLTR

SEQ ID NO: 1710 - protein, 7 aa, Artificial Sequence
  Description of Artificial Sequence: example ZFP
QSGTLTR

SEQ ID NO: 1711 - protein, 7 aa, Artificial Sequence
  Description of Artificial Sequence: example ZFP
RSDHLAR

SEQ ID NO: 1712 - protein, 7 aa, Artificial Sequence
  Description of Artificial Sequence: example ZFP
RSDHLAR

SEQ ID NO: 1713 - protein, 7 aa, Artificial Sequence
  Description of Artificial Sequence: example ZFP
QSSNLQR

SEQ ID NO: 1714 - protein, 7 aa, Artificial Sequence
  Description of Artificial Sequence: example ZFP
RSDHLSR

SEQ ID NO: 1715 - protein, 7 aa, Artificial Sequence
  Description of Artificial Sequence: example ZFP
RSDHLSR

SEQ ID NO: 1716 - protein, 7 aa, Artificial Sequence
  Description of Artificial Sequence: example ZFP
RSDHLSR

SEQ ID NO: 1717 - protein, 7 aa, Artificial Sequence
  Description of Artificial Sequence: example ZFP
RSDHLSR

SEQ ID NO: 1718 - protein, 7 aa, Artificial Sequence
  Description of Artificial Sequence: example ZFP
RSDHLSR

SEQ ID NO: 1719 - protein, 7 aa, Artificial Sequence
  Description of Artificial Sequence: example ZFP
DRSALAR

SEQ ID NO: 1720 - protein, 7 aa, Artificial Sequence
  Description of Artificial Sequence: example ZFP
RSDHLTR

SEQ ID NO: 1721 - protein, 7 aa, Artificial Sequence
  Description of Artificial Sequence: example ZFP
RSSHLTR

SEQ ID NO: 1722 - protein, 7 aa, Artificial Sequence
  Description of Artificial Sequence: example ZFP
RSDNLAR

SEQ ID NO: 1723 - protein, 7 aa, Artificial Sequence
  Description of Artificial Sequence: example ZFP
QSGNLAR

SEQ ID NO: 1724 - protein, 7 aa, Artificial Sequence
  Description of Artificial Sequence: example ZFP
QSANLAR

SEQ ID NO: 1725 - protein, 7 aa, Artificial Sequence
  Description of Artificial Sequence: example ZFP
QSGNLSR

SEQ ID NO: 1726 - protein, 7 aa, Artificial Sequence
  Description of Artificial Sequence: example ZFP
QSSDLQR

SEQ ID NO: 1727 - protein, 7 aa, Artificial Sequence
  Description of Artificial Sequence: example ZFP
TTSDLTR

SEQ ID NO: 1728 - protein, 7 aa, Artificial Sequence
  Description of Artificial Sequence: example ZFP
QSGNLRT

SEQ ID NO: 1729 - protein, 7 aa, Artificial Sequence
  Description of Artificial Sequence: example ZFP
QSGNLRT

SEQ ID NO: 1730 - protein, 7 aa, Artificial Sequence
  Description of Artificial Sequence: example ZFP
QSGNLRT

SEQ ID NO: 1731 - protein, 7 aa, Artificial Sequence
  Description of Artificial Sequence: example ZFP
QSGNLRT

SEQ ID NO: 1732 - protein, 7 aa, Artificial Sequence
  Description of Artificial Sequence: example ZFP
NRATLAR

SEQ ID NO: 1733 - protein, 7 aa, Artificial Sequence
  Description of Artificial Sequence: example ZFP
TTSALTR

SEQ ID NO: 1734 - protein, 7 aa, Artificial Sequence
  Description of Artificial Sequence: example ZFP
RSDDVTR

SEQ ID NO: 1735 - protein, 7 aa, Artificial Sequence
  Description of Artificial Sequence: example ZFP
RSDNLTR

SEQ ID NO: 1736 - protein, 7 aa, Artificial Sequence
  Description of Artificial Sequence: example ZFP
RSDNLTR

SEQ ID NO: 1737 - protein, 7 aa, Artificial Sequence
  Description of Artificial Sequence: example ZFP
RSDNLTR

SEQ ID NO: 1738 - protein, 7 aa, Artificial Sequence
  Description of Artificial Sequence: example ZFP
RSDNLTR

SEQ ID NO: 1739 - protein, 7 aa, Artificial Sequence
  Description of Artificial Sequence: example ZFP
RSSNLTR

SEQ ID NO: 1740 - protein, 7 aa, Artificial Sequence
  Description of Artificial Sequence: example ZFP
RSDELTR

SEQ ID NO: 1741 - protein, 7 aa, Artificial Sequence
  Description of Artificial Sequence: example ZFP
RSDELTR

SEQ ID NO: 1742 - protein, 7 aa, Artificial Sequence
  Description of Artificial Sequence: example ZFP
QSGSLTR

SEQ ID NO: 1743 - protein, 7 aa, Artificial Sequence
  Description of Artificial Sequence: example ZFP
QSGDLTR

SEQ ID NO: 1744 - protein, 7 aa, Artificial Sequence
  Description of Artificial Sequence: example ZFP
RSDNLAR

SEQ ID NO: 1745 - protein, 7 aa, Artificial Sequence
  Description of Artificial Sequence: example ZFP
RSDNLAR

SEQ ID NO: 1746 - protein, 7 aa, Artificial Sequence
  Description of Artificial Sequence: example ZFP
QSGDLTR

SEQ ID NO: 1747 - protein, 7 aa, Artificial Sequence
  Description of Artificial Sequence: example ZFP
RSDHLAR

SEQ ID NO: 1748 - protein, 7 aa, Artificial Sequence
  Description of Artificial Sequence: example ZFP
RSDHLAR

SEQ ID NO: 1749 - protein, 7 aa, Artificial Sequence
  Description of Artificial Sequence: example ZFP
QSANLAR

SEQ ID NO: 1750 - protein, 7 aa, Artificial Sequence
  Description of Artificial Sequence: example ZFP
QSANLAR

SEQ ID NO: 1751 - protein, 7 aa, Artificial Sequence
  Description of Artificial Sequence: example ZFP
QSGNLAR

SEQ ID NO: 1752 - protein, 7 aa, Artificial Sequence
  Description of Artificial Sequence: example ZFP
QSGNLAR

SEQ ID NO: 1753 - protein, 7 aa, Artificial Sequence
  Description of Artificial Sequence: example ZFP
RSDNLAR

SEQ ID NO: 1754 - protein, 7 aa, Artificial Sequence
  Description of Artificial Sequence: example ZFP
RSDNLAR

SEQ ID NO: 1755 - protein, 7 aa, Artificial Sequence
  Description of Artificial Sequence: example ZFP
RSDELRR

SEQ ID NO: 1756 - protein, 7 aa, Artificial Sequence
  Description of Artificial Sequence: example ZFP
RADTLRR

SEQ ID NO: 1757 - protein, 7 aa, Artificial Sequence
  Description of Artificial Sequence: example ZFP
QSGSLTR

SEQ ID NO: 1758 - protein, 7 aa, Artificial Sequence
  Description of Artificial Sequence: example ZFP
QSGSLTR

SEQ ID NO: 1759 - protein, 7 aa, Artificial Sequence
  Description of Artificial Sequence: example ZFP
QSGSLTR

SEQ ID NO: 1760 - protein, 7 aa, Artificial Sequence
  Description of Artificial Sequence: example ZFP
RSDALTR

SEQ ID NO: 1761 - protein, 7 aa, Artificial Sequence
  Description of Artificial Sequence: example ZFP
TTSNLAR

SEQ ID NO: 1762 - protein, 7 aa, Artificial Sequence
  Description of Artificial Sequence: example ZFP
RSDALTR

SEQ ID NO: 1763 - protein, 7 aa, Artificial Sequence
  Description of Artificial Sequence: example ZFP
RSDALTR

SEQ ID NO: 1764 - protein, 7 aa, Artificial Sequence
  Description of Artificial Sequence: example ZFP
QSSALAR

SEQ ID NO: 1765 - protein, 7 aa, Artificial Sequence
  Description of Artificial Sequence: example ZFP
QSSNLAR

SEQ ID NO: 1766 - protein, 7 aa, Artificial Sequence
  Description of Artificial Sequence: example ZFP
QSSDLTR

SEQ ID NO: 1767 - protein, 7 aa, Artificial Sequence
  Description of Artificial Sequence: example ZFP
RSDNLAR

SEQ ID NO: 1768 - protein, 7 aa, Artificial Sequence
  Description of Artificial Sequence: example ZFP
RSDNLAR

SEQ ID NO: 1769 - protein, 7 aa, Artificial Sequence
  Description of Artificial Sequence: example ZFP
RSDDLTR

SEQ ID NO: 1770 - protein, 7 aa, Artificial Sequence
  Description of Artificial Sequence: example ZFP
RSDNLAR

SEQ ID NO: 1771 - protein, 7 aa, Artificial Sequence
  Description of Artificial Sequence: example ZFP
RSDHLAR

SEQ ID NO: 1772 - protein, 7 aa, Artificial Sequence
  Description of Artificial Sequence: example ZFP
RSDHLAR

SEQ ID NO: 1773 - protein, 7 aa, Artificial Sequence
  Description of Artificial Sequence: example ZFP
RSDHLAR

SEQ ID NO: 1774 - protein, 7 aa, Artificial Sequence
  Description of Artificial Sequence: example ZFP
QSSDLTR

SEQ ID NO: 1775 - protein, 7 aa, Artificial Sequence
  Description of Artificial Sequence: example ZFP
RSDHLAR

SEQ ID NO: 1776 - protein, 7 aa, Artificial Sequence
  Description of Artificial Sequence: example ZFP
RSDNLAR

SEQ ID NO: 1777 - protein, 7 aa, Artificial Sequence
  Description of Artificial Sequence: example ZFP
QSGSLTR

SEQ ID NO: 1778 - protein, 7 aa, Artificial Sequence
  Description of Artificial Sequence: example ZFP
RSDNLTR

SEQ ID NO: 1779 - protein, 7 aa, Artificial Sequence
  Description of Artificial Sequence: example ZFP
QRGALAS

SEQ ID NO: 1780 - protein, 7 aa, Artificial Sequence
  Description of Artificial Sequence: example ZFP
QRGALAS

SEQ ID NO: 1781 - protein, 7 aa, Artificial Sequence
  Description of Artificial Sequence: example ZFP
QRSALAS

SEQ ID NO: 1782 - protein, 7 aa, Artificial Sequence
  Description of Artificial Sequence: example ZFP
QRSALAS

SEQ ID NO: 1783 - protein, 7 aa, Artificial Sequence
  Description of Artificial Sequence: example ZFP
QSGSLTR

SEQ ID NO: 1784 - protein, 7 aa, Artificial Sequence
  Description of Artificial Sequence: example ZFP
RSDHLTT

SEQ ID NO: 1785 - protein, 7 aa, Artificial Sequence
  Description of Artificial Sequence: example ZFP
DSGHLTR

SEQ ID NO: 1786 - protein, 7 aa, Artificial Sequence
  Description of Artificial Sequence: example ZFP
DRSHLTR

SEQ ID NO: 1787 - protein, 7 aa, Artificial Sequence
  Description of Artificial Sequence: example ZFP
RSDELTR

SEQ ID NO: 1788 - protein, 7 aa, Artificial Sequence
  Description of Artificial Sequence: example ZFP
RSDNLAR

SEQ ID NO: 1789 - protein, 7 aa, Artificial Sequence
  Description of Artificial Sequence: example ZFP
RSHHLAR

SEQ ID NO: 1790 - protein, 7 aa, Artificial Sequence
  Description of Artificial Sequence: example ZFP
QSSDLRR

SEQ ID NO: 1791 - protein, 7 aa, Artificial Sequence
  Description of Artificial Sequence: example ZFP
QSSDLRR

SEQ ID NO: 1792 - protein, 7 aa, Artificial Sequence
  Description of Artificial Sequence: example ZFP
DSGHLTR

SEQ ID NO: 1793 - protein, 7 aa, Artificial Sequence
  Description of Artificial Sequence: example ZFP
DRSHLTR

SEQ ID NO: 1794 - protein, 7 aa, Artificial Sequence
  Description of Artificial Sequence: example ZFP
QSSDLQR

SEQ ID NO: 1795 - protein, 7 aa, Artificial Sequence
  Description of Artificial Sequence: example ZFP
QSSDLQR

SEQ ID NO: 1796 - protein, 7 aa, Artificial Sequence
  Description of Artificial Sequence: example ZFP
RSDHLAR

SEQ ID NO: 1797 - protein, 7 aa, Artificial Sequence
  Description of Artificial Sequence: example ZFP
RSDHLAR

SEQ ID NO: 1798 - protein, 7 aa, Artificial Sequence
  Description of Artificial Sequence: example ZFP
QSGSLTR

SEQ ID NO: 1799 - protein, 7 aa, Artificial Sequence
  Description of Artificial Sequence: example ZFP
QSGSLTR

SEQ ID NO: 1800 - protein, 7 aa, Artificial Sequence
  Description of Artificial Sequence: example ZFP
RSSNLRE

SEQ ID NO: 1801 - protein, 7 aa, Artificial Sequence
  Description of Artificial Sequence: example ZFP
RSDELTR

SEQ ID NO: 1802 - protein, 7 aa, Artificial Sequence
  Description of Artificial Sequence: example ZFP
RSDTLKK

SEQ ID NO: 1803 - protein, 7 aa, Artificial Sequence
  Description of Artificial Sequence: example ZFP
RSDTLKK

SEQ ID NO: 1804 - protein, 7 aa, Artificial Sequence
  Description of Artificial Sequence: example ZFP
QSDNLAR

SEQ ID NO: 1805 - protein, 7 aa, Artificial Sequence
  Description of Artificial Sequence: example ZFP
RSDELTR

SEQ ID NO: 1806 - protein, 7 aa, Artificial Sequence
  Description of Artificial Sequence: example ZFP
RADTLRR

SEQ ID NO: 1807 - protein, 7 aa, Artificial Sequence
  Description of Artificial Sequence: example ZFP
RSDELTR

SEQ ID NO: 1808 - protein, 7 aa, Artificial Sequence
  Description of Artificial Sequence: example ZFP
RSDELTR

SEQ ID NO: 1809 - protein, 7 aa, Artificial Sequence
  Description of Artificial Sequence: example ZFP
RSDSLAR

SEQ ID NO: 1810 - protein, 7 aa, Artificial Sequence
  Description of Artificial Sequence: example ZFP
QSSDLQR

SEQ ID NO: 1811 - protein, 7 aa, Artificial Sequence
  Description of Artificial Sequence: example ZFP
QSSDLQR

SEQ ID NO: 1812 - protein, 7 aa, Artificial Sequence
  Description of Artificial Sequence: example ZFP
QSSDLQR

SEQ ID NO: 1813 - protein, 7 aa, Artificial Sequence
  Description of Artificial Sequence: example ZFP
QSSDLQR

SEQ ID NO: 1814 - protein, 7 aa, Artificial Sequence
  Description of Artificial Sequence: example ZFP
QSSDLQR

SEQ ID NO: 1815 - protein, 7 aa, Artificial Sequence
  Description of Artificial Sequence: example ZFP
RSDNLAR

SEQ ID NO: 1816 - protein, 7 aa, Artificial Sequence
  Description of Artificial Sequence: example ZFP
RSDHLTR

SEQ ID NO: 1817 - protein, 7 aa, Artificial Sequence
  Description of Artificial Sequence: example ZFP
RSDHLTR

SEQ ID NO: 1818 - protein, 7 aa, Artificial Sequence
  Description of Artificial Sequence: example ZFP
RSDHLTR

SEQ ID NO: 1819 - protein, 7 aa, Artificial Sequence
  Description of Artificial Sequence: example ZFP
RSDHLTR

SEQ ID NO: 1820 - protein, 7 aa, Artificial Sequence
  Description of Artificial Sequence: example ZFP
RSDHLTR

SEQ ID NO: 1821 - protein, 7 aa, Artificial Sequence
  Description of Artificial Sequence: example ZFP
TSANLAR

SEQ ID NO: 1822 - protein, 7 aa, Artificial Sequence
  Description of Artificial Sequence: example ZFP
RSDNLTT

SEQ ID NO: 1823 - protein, 7 aa, Artificial Sequence
  Description of Artificial Sequence: example ZFP
RSDNLTT

SEQ ID NO: 1824 - protein, 7 aa, Artificial Sequence
  Description of Artificial Sequence: example ZFP
QSGHLQR

SEQ ID NO: 1825 - protein, 7 aa, Artificial Sequence
  Description of Artificial Sequence: example ZFP
RSDALAR

SEQ ID NO: 1826 - protein, 7 aa, Artificial Sequence
  Description of Artificial Sequence: example ZFP
RSDALAR

SEQ ID NO: 1827 - protein, 7 aa, Artificial Sequence
  Description of Artificial Sequence: example ZFP
RSDALAR

SEQ ID NO: 1828 - protein, 7 aa, Artificial Sequence
  Description of Artificial Sequence: example ZFP
RSDNLAR

SEQ ID NO: 1829 - protein, 7 aa, Artificial Sequence
  Description of Artificial Sequence: example ZFP
RSDNLAR

SEQ ID NO: 1830 - protein, 7 aa, Artificial Sequence
  Description of Artificial Sequence: example ZFP
QSGSLTR

SEQ ID NO: 1831 - protein, 7 aa, Artificial Sequence
  Description of Artificial Sequence: example ZFP
QSSTLRR

SEQ ID NO: 1832 - protein, 7 aa, Artificial Sequence
  Description of Artificial Sequence: example ZFP
QSGSLTR

SEQ ID NO: 1833 - protein, 7 aa, Artificial Sequence
  Description of Artificial Sequence: example ZFP
QSSTLRR

SEQ ID NO: 1834 - protein, 7 aa, Artificial Sequence
  Description of Artificial Sequence: example ZFP
QSGHLTR

SEQ ID NO: 1835 - protein, 7 aa, Artificial Sequence
  Description of Artificial Sequence: example ZFP
QSGHLTR

SEQ ID NO: 1836 - protein, 7 aa, Artificial Sequence
  Description of Artificial Sequence: example ZFP
RSDNLTR

SEQ ID NO: 1837 - protein, 7 aa, Artificial Sequence
  Description of Artificial Sequence: example ZFP
RSDELQR

SEQ ID NO: 1838 - protein, 7 aa, Artificial Sequence
  Description of Artificial Sequence: example ZFP
RSDELQR

SEQ ID NO: 1839 - protein, 7 aa, Artificial Sequence
  Description of Artificial Sequence: example ZFP
RADTLRR

SEQ ID NO: 1840 - protein, 7 aa, Artificial Sequence
  Description of Artificial Sequence: example ZFP
RADTLRR

SEQ ID NO: 1841 - protein, 7 aa, Artificial Sequence
  Description of Artificial Sequence: example ZFP
DRSHLAR

SEQ ID NO: 1842 - protein, 7 aa, Artificial Sequence
  Description of Artificial Sequence: example ZFP
RSDELSR

SEQ ID NO: 1843 - protein, 7 aa, Artificial Sequence
  Description of Artificial Sequence: example ZFP
RSDELSR

SEQ ID NO: 1844 - protein, 7 aa, Artificial Sequence
  Description of Artificial Sequence: example ZFP
RSDDLQR

SEQ ID NO: 1845 - protein, 7 aa, Artificial Sequence
  Description of Artificial Sequence: example ZFP
RSDDLQR

SEQ ID NO: 1846 - protein, 7 aa, Artificial Sequence
  Description of Artificial Sequence: example ZFP
RSDELQR

SEQ ID NO: 1847 - protein, 7 aa, Artificial Sequence
  Description of Artificial Sequence: example ZFP
RSDELQR

SEQ ID NO: 1848 - protein, 7 aa, Artificial Sequence
  Description of Artificial Sequence: example ZFP
RSDSLAR

SEQ ID NO: 1849 - protein, 7 aa, Artificial Sequence
  Description of Artificial Sequence: example ZFP
RSDSLAR

SEQ ID NO: 1850 - protein, 7 aa, Artificial Sequence
  Description of Artificial Sequence: example ZFP
RSDSLLR

SEQ ID NO: 1851 - protein, 7 aa, Artificial Sequence
  Description of Artificial Sequence: example ZFP
RQDTLVG

SEQ ID NO: 1852 - protein, 7 aa, Artificial Sequence
  Description of Artificial Sequence: example ZFP
RKDVLVS

SEQ ID NO: 1853 - protein, 7 aa, Artificial Sequence
  Description of Artificial Sequence: example ZFP
RLDGLRT

SEQ ID NO: 1854 - protein, 7 aa, Artificial Sequence
  Description of Artificial Sequence: example ZFP
RQDTLVG

SEQ ID NO: 1855 - protein, 7 aa, Artificial Sequence
  Description of Artificial Sequence: example ZFP
RSDNLAR

SEQ ID NO: 1856 - protein, 7 aa, Artificial Sequence
  Description of Artificial Sequence: example ZFP
RSDNLAR

SEQ ID NO: 1857 - protein, 7 aa, Artificial Sequence
  Description of Artificial Sequence: example ZFP
DRSALAR

SEQ ID NO: 1858 - protein, 7 aa, Artificial Sequence
  Description of Artificial Sequence: example ZFP
DRSALAR

SEQ ID NO: 1859 - protein, 7 aa, Artificial Sequence
  Description of Artificial Sequence: example ZFP
QSGHLQR

SEQ ID NO: 1860 - protein, 7 aa, Artificial Sequence
  Description of Artificial Sequence: example ZFP
QSGHLQR

SEQ ID NO: 1861 - protein, 7 aa, Artificial Sequence
  Description of Artificial Sequence: example ZFP
QSGHLQR

SEQ ID NO: 1862 - protein, 7 aa, Artificial Sequence
  Description of Artificial Sequence: example ZFP
RSDALTS

SEQ ID NO: 1863 - protein, 7 aa, Artificial Sequence
  Description of Artificial Sequence: example ZFP
RSDNLAR

SEQ ID NO: 1864 - protein, 7 aa, Artificial Sequence
  Description of Artificial Sequence: example ZFP
RSDHLTR

SEQ ID NO: 1865 - protein, 7 aa, Artificial Sequence
  Description of Artificial Sequence: example ZFP
RSDALRQ

SEQ ID NO: 1866 - protein, 7 aa, Artificial Sequence
  Description of Artificial Sequence: example ZFP
QSGHLQK

SEQ ID NO: 1867 - protein, 7 aa, Artificial Sequence
  Description of Artificial Sequence: example ZFP
RSDNLAR

SEQ ID NO: 1868 - protein, 7 aa, Artificial Sequence
  Description of Artificial Sequence: example ZFP
RSDALSR

SEQ ID NO: 1869 - protein, 7 aa, Artificial Sequence
  Description of Artificial Sequence: example ZFP
RSDNLAR

SEQ ID NO: 1870 - protein, 7 aa, Artificial Sequence
  Description of Artificial Sequence: example ZFP
RSDHLSR

SEQ ID NO: 1871 - protein, 7 aa, Artificial Sequence
  Description of Artificial Sequence: example ZFP
DRSALAR

SEQ ID NO: 1872 - protein, 7 aa, Artificial Sequence
  Description of Artificial Sequence: example ZFP
RSDHLSR

SEQ ID NO: 1873 - protein, 7 aa, Artificial Sequence
  Description of Artificial Sequence: example ZFP
QSSHLAR

SEQ ID NO: 1874 - protein, 7 aa, Artificial Sequence
  Description of Artificial Sequence: example ZFP
QSSHLAR

SEQ ID NO: 1875 - protein, 7 aa, Artificial Sequence
  Description of Artificial Sequence: example ZFP
QSSDLSR

SEQ ID NO: 1876 - protein, 7 aa, Artificial Sequence
  Description of Artificial Sequence: example ZFP
RSDALSR

SEQ ID NO: 1877 - protein, 7 aa, Artificial Sequence
  Description of Artificial Sequence: example ZFP
RSDALSR

SEQ ID NO: 1878 - protein, 7 aa, Artificial Sequence
  Description of Artificial Sequence: example ZFP
RSDHLSR

SEQ ID NO: 1879 - protein, 7 aa, Artificial Sequence
  Description of Artificial Sequence: example ZFP
RSDALAR

SEQ ID NO: 1880 - protein, 7 aa, Artificial Sequence
  Description of Artificial Sequence: example ZFP
QSSDLQR

SEQ ID NO: 1881 - protein, 7 aa, Artificial Sequence
  Description of Artificial Sequence: example ZFP
RSDHLSR

SEQ ID NO: 1882 - protein, 7 aa, Artificial Sequence
  Description of Artificial Sequence: example ZFP
RSDHLSR

SEQ ID NO: 1883 - protein, 7 aa, Artificial Sequence
  Description of Artificial Sequence: example ZFP
RSDHLSR

SEQ ID NO: 1884 - protein, 7 aa, Artificial Sequence
  Description of Artificial Sequence: example ZFP
RSDHLSR

SEQ ID NO: 1885 - protein, 7 aa, Artificial Sequence
  Description of Artificial Sequence: example ZFP
QSGNLAR

SEQ ID NO: 1886 - protein, 7 aa, Artificial Sequence
  Description of Artificial Sequence: example ZFP
QSSALRT

SEQ ID NO: 1887 - protein, 7 aa, Artificial Sequence
  Description of Artificial Sequence: example ZFP
DRSNLER

SEQ ID NO: 1888 - protein, 7 aa, Artificial Sequence
  Description of Artificial Sequence: example ZFP
DSSNLTR

SEQ ID NO: 1889 - protein, 7 aa, Artificial Sequence
  Description of Artificial Sequence: example ZFP
QSAHLAR

SEQ ID NO: 1890 - protein, 7 aa, Artificial Sequence
  Description of Artificial Sequence: example ZFP
RSDNLAR

SEQ ID NO: 1891 - protein, 7 aa, Artificial Sequence
  Description of Artificial Sequence: example ZFP
RSDALSR

SEQ ID NO: 1892 - protein, 7 aa, Artificial Sequence
  Description of Artificial Sequence: example ZFP
RSDELQR

SEQ ID NO: 1893 - protein, 7 aa, Artificial Sequence
  Description of Artificial Sequence: example ZFP
RADTLRR

SEQ ID NO: 1894 - protein, 7 aa, Artificial Sequence
  Description of Artificial Sequence: example ZFP
DSSNLTR

SEQ ID NO: 1895 - protein, 7 aa, Artificial Sequence
  Description of Artificial Sequence: example ZFP
DRSNLER

SEQ ID NO: 1896 - protein, 7 aa, Artificial Sequence
  Description of Artificial Sequence: example ZFP
RSDALSR

SEQ ID NO: 1897 - protein, 7 aa, Artificial Sequence
  Description of Artificial Sequence: example ZFP
RSDALSR

SEQ ID NO: 1898 - protein, 7 aa, Artificial Sequence
  Description of Artificial Sequence: example ZFP
DRSNLER

SEQ ID NO: 1899 - protein, 7 aa, Artificial Sequence
  Description of Artificial Sequence: example ZFP
DRSNLTR

SEQ ID NO: 1900 - protein, 7 aa, Artificial Sequence
  Description of Artificial Sequence: example ZFP
QSGHLTR

SEQ ID NO: 1901 - protein, 7 aa, Artificial Sequence
  Description of Artificial Sequence: example ZFP
QSGHLTR

SEQ ID NO: 1902 - protein, 7 aa, Artificial Sequence
  Description of Artificial Sequence: example ZFP
RSDNLAR

SEQ ID NO: 1903 - protein, 7 aa, Artificial Sequence
  Description of Artificial Sequence: example ZFP
QSGHLQR

SEQ ID NO: 1904 - protein, 7 aa, Artificial Sequence
  Description of Artificial Sequence: example ZFP
QSGHLQR

SEQ ID NO: 1905 - protein, 7 aa, Artificial Sequence
  Description of Artificial Sequence: example ZFP
QSGHLQR

SEQ ID NO: 1906 - protein, 7 aa, Artificial Sequence
  Description of Artificial Sequence: example ZFP
RSDNLAR

SEQ ID NO: 1907 - protein, 7 aa, Artificial Sequence
  Description of Artificial Sequence: example ZFP
QSGHLAR

SEQ ID NO: 1908 - protein, 7 aa, Artificial Sequence
  Description of Artificial Sequence: example ZFP
QSGHLAR

SEQ ID NO: 1909 - protein, 7 aa, Artificial Sequence
  Description of Artificial Sequence: example ZFP
RSDHLTT

SEQ ID NO: 1910 - protein, 7 aa, Artificial Sequence
  Description of Artificial Sequence: example ZFP
RSDHLTT

SEQ ID NO: 1911 - protein, 7 aa, Artificial Sequence
  Description of Artificial Sequence: example ZFP
RLDNRTA

SEQ ID NO: 1912 - protein, 7 aa, Artificial Sequence
  Description of Artificial Sequence: example ZFP
RSDSLTK

SEQ ID NO: 1913 - protein, 7 aa, Artificial Sequence
  Description of Artificial Sequence: example ZFP
RSDALAR

SEQ ID NO: 1914 - protein, 7 aa, Artificial Sequence
  Description of Artificial Sequence: example ZFP
RSDALAR

SEQ ID NO: 1915 - protein, 7 aa, Artificial Sequence
  Description of Artificial Sequence: example ZFP
RGDALTS

SEQ ID NO: 1916 - protein, 7 aa, Artificial Sequence
  Description of Artificial Sequence: example ZFP
RSDSLTK

SEQ ID NO: 1917 - protein, 7 aa, Artificial Sequence
  Description of Artificial Sequence: example ZFP
RSDNLQR

SEQ ID NO: 1918 - protein, 7 aa, Artificial Sequence
  Description of Artificial Sequence: example ZFP
RKDNMTA

SEQ ID NO: 1919 - protein, 7 aa, Artificial Sequence
  Description of Artificial Sequence: example ZFP
RKDNMTQ

SEQ ID NO: 1920 - protein, 7 aa, Artificial Sequence
  Description of Artificial Sequence: example ZFP
RKDNMTN

SEQ ID NO: 1921 - protein, 7 aa, Artificial Sequence
  Description of Artificial Sequence: example ZFP
RLDNRTA

SEQ ID NO: 1922 - protein, 7 aa, Artificial Sequence
  Description of Artificial Sequence: example ZFP
RLDNRTQ

SEQ ID NO: 1923 - protein, 7 aa, Artificial Sequence
  Description of Artificial Sequence: example ZFP
RSDTLRS

SEQ ID NO: 1924 - protein, 7 aa, Artificial Sequence
  Description of Artificial Sequence: example ZFP
RGDALTS

SEQ ID NO: 1925 - protein, 7 aa, Artificial Sequence
  Description of Artificial Sequence: example ZFP
RGDALTS

SEQ ID NO: 1926 - protein, 7 aa, Artificial Sequence
  Description of Artificial Sequence: example ZFP
RSDHLRE

SEQ ID NO: 1927 - protein, 7 aa, Artificial Sequence
  Description of Artificial Sequence: example ZFP
RGDALTS

SEQ ID NO: 1928 - protein, 7 aa, Artificial Sequence
  Description of Artificial Sequence: example ZFP
RGDALTS

SEQ ID NO: 1929 - protein, 7 aa, Artificial Sequence
  Description of Artificial Sequence: example ZFP
NRATLAR

SEQ ID NO: 1930 - protein, 7 aa, Artificial Sequence
  Description of Artificial Sequence: example ZFP
RSDNLTT

SEQ ID NO: 1931 - protein, 7 aa, Artificial Sequence
  Description of Artificial Sequence: example ZFP
RSDNLTT

SEQ ID NO: 1932 - protein, 7 aa, Artificial Sequence
  Description of Artificial Sequence: example ZFP
RSDNLTT

SEQ ID NO: 1933 - protein, 7 aa, Artificial Sequence
  Description of Artificial Sequence: example ZFP
RSDNLTT

SEQ ID NO: 1934 - protein, 7 aa, Artificial Sequence
  Description of Artificial Sequence: example ZFP
RSDNLTS

SEQ ID NO: 1935 - protein, 7 aa, Artificial Sequence
  Description of Artificial Sequence: example ZFP
RSDNLTS

SEQ ID NO: 1936 - protein, 7 aa, Artificial Sequence
  Description of Artificial Sequence: example ZFP
RSDNLAR

SEQ ID NO: 1937 - protein, 7 aa, Artificial Sequence
  Description of Artificial Sequence: example ZFP
RSDNLAR

SEQ ID NO: 1938 - protein, 7 aa, Artificial Sequence
  Description of Artificial Sequence: example ZFP
RSDDLRR

SEQ ID NO: 1939 - protein, 7 aa, Artificial Sequence
  Description of Artificial Sequence: example ZFP
RLDNRTA

SEQ ID NO: 1940 - protein, 7 aa, Artificial Sequence
  Description of Artificial Sequence: example ZFP
RSDNLTQ

SEQ ID NO: 1941 - protein, 7 aa, Artificial Sequence
  Description of Artificial Sequence: example ZFP
RLDNRTA

SEQ ID NO: 1942 - protein, 7 aa, Artificial Sequence
  Description of Artificial Sequence: example ZFP
RSDNLTQ

SEQ ID NO: 1943 - protein, 7 aa, Artificial Sequence
  Description of Artificial Sequence: example ZFP
RSDHLTR

SEQ ID NO: 1944 - protein, 7 aa, Artificial Sequence
  Description of Artificial Sequence: example ZFP
QSGHLTK

SEQ ID NO: 1945 - protein, 7 aa, Artificial Sequence
  Description of Artificial Sequence: example ZFP
QSHGLTS

SEQ ID NO: 1946 - protein, 7 aa, Artificial Sequence
  Description of Artificial Sequence: example ZFP
RSDERKR

SEQ ID NO: 1947 - protein, 7 aa, Artificial Sequence
  Description of Artificial Sequence: example ZFP
RSDERKR

SEQ ID NO: 1948 - protein, 7 aa, Artificial Sequence
  Description of Artificial Sequence: example ZFP
QSGSLTR

SEQ ID NO: 1949 - protein, 7 aa, Artificial Sequence
  Description of Artificial Sequence: example ZFP
QSGDLTR

SEQ ID NO: 1950 - protein, 7 aa, Artificial Sequence
  Description of Artificial Sequence: example ZFP
RSDNLTQ

SEQ ID NO: 1951 - protein, 7 aa, Artificial Sequence
  Description of Artificial Sequence: example ZFP
RSDHLSR

SEQ ID NO: 1952 - protein, 7 aa, Artificial Sequence
  Description of Artificial Sequence: example ZFP
RSDHLSR

SEQ ID NO: 1953 - protein, 7 aa, Artificial Sequence
  Description of Artificial Sequence: example ZFP
RSDNLAR

SEQ ID NO: 1954 - protein, 7 aa, Artificial Sequence
  Description of Artificial Sequence: example ZFP
RSDNLAR

SEQ ID NO: 1955 - protein, 7 aa, Artificial Sequence
  Description of Artificial Sequence: example ZFP
RSDNLAR

SEQ ID NO: 1956 - protein, 7 aa, Artificial Sequence
  Description of Artificial Sequence: example ZFP
RSDNLAR

SEQ ID NO: 1957 - protein, 7 aa, Artificial Sequence
  Description of Artificial Sequence: example ZFP
MSDHLSR

SEQ ID NO: 1958 - protein, 7 aa, Artificial Sequence
  Description of Artificial Sequence: example ZFP
MSHHLSR

SEQ ID NO: 1959 - protein, 7 aa, Artificial Sequence
  Description of Artificial Sequence: example ZFP
RSDHLTT

SEQ ID NO: 1960 - protein, 7 aa, Artificial Sequence
  Description of Artificial Sequence: example ZFP
RSDHLTT

SEQ ID NO: 1961 - protein, 7 aa, Artificial Sequence
  Description of Artificial Sequence: example ZFP
RGDALTS

SEQ ID NO: 1962 - protein, 7 aa, Artificial Sequence
  Description of Artificial Sequence: example ZFP
RSDALTK

SEQ ID NO: 1963 - protein, 7 aa, Artificial Sequence
  Description of Artificial Sequence: example ZFP
RSDALTR

SEQ ID NO: 1964 - protein, 7 aa, Artificial Sequence
  Description of Artificial Sequence: example ZFP
DRSHLAR

SEQ ID NO: 1965 - protein, 7 aa, Artificial Sequence
  Description of Artificial Sequence: example ZFP
QSGNLTR

SEQ ID NO: 1966 - protein, 7 aa, Artificial Sequence
  Description of Artificial Sequence: example ZFP
RSDALRQ

SEQ ID NO: 1967 - protein, 7 aa, Artificial Sequence
  Description of Artificial Sequence: example ZFP
DRSHLAR

SEQ ID NO: 1968 - protein, 7 aa, Artificial Sequence
  Description of Artificial Sequence: example ZFP
QSSDLQR

SEQ ID NO: 1969 - protein, 7 aa, Artificial Sequence
  Description of Artificial Sequence: example ZFP
QSGNLTR

SEQ ID NO: 1970 - protein, 7 aa, Artificial Sequence
  Description of Artificial Sequence: example ZFP
RSDTLKK

SEQ ID NO: 1971 - protein, 7 aa, Artificial Sequence
  Description of Artificial Sequence: example ZFP
DSSKLSR

SEQ ID NO: 1972 - protein, 7 aa, Artificial Sequence
  Description of Artificial Sequence: example ZFP
QSGHLAR

SEQ ID NO: 1973 - protein, 7 aa, Artificial Sequence
  Description of Artificial Sequence: example ZFP
RSDHLTT

SEQ ID NO: 1974 - protein, 7 aa, Artificial Sequence
  Description of Artificial Sequence: example ZFP
RSDALAR

SEQ ID NO: 1975 - protein, 7 aa, Artificial Sequence
  Description of Artificial Sequence: example ZFP
RSDDLTR

SEQ ID NO: 1976 - protein, 7 aa, Artificial Sequence
  Description of Artificial Sequence: example ZFP
RSDTLKK

SEQ ID NO: 1977 - protein, 7 aa, Artificial Sequence
  Description of Artificial Sequence: example ZFP
RSDHLSR

SEQ ID NO: 1978 - protein, 7 aa, Artificial Sequence
  Description of Artificial Sequence: example ZFP
RSDERKR

SEQ ID NO: 1979 - protein, 7 aa, Artificial Sequence
  Description of Artificial Sequence: example ZFP
RSDNLSR

SEQ ID NO: 1980 - protein, 7 aa, Artificial Sequence
  Description of Artificial Sequence: example ZFP
QRGHLSR

SEQ ID NO: 1981 - protein, 7 aa, Artificial Sequence
  Description of Artificial Sequence: example ZFP
RSDNRTA

SEQ ID NO: 1982 - protein, 7 aa, Artificial Sequence
  Description of Artificial Sequence: example ZFP
RSDNLTQ

SEQ ID NO: 1983 - protein, 7 aa, Artificial Sequence
  Description of Artificial Sequence: example ZFP
RSDTLKQ

SEQ ID NO: 1984 - protein, 7 aa, Artificial Sequence
  Description of Artificial Sequence: example ZFP
RSDTLTQ

SEQ ID NO: 1985 - protein, 7 aa, Artificial Sequence
  Description of Artificial Sequence: example ZFP
RSDTLKQ

SEQ ID NO: 1986 - protein, 7 aa, Artificial Sequence
  Description of Artificial Sequence: example ZFP
RSDTLTQ

SEQ ID NO: 1987 - protein, 7 aa, Artificial Sequence
  Description of Artificial Sequence: example ZFP
RSDALRE

SEQ ID NO: 1988 - protein, 7 aa, Artificial Sequence
  Description of Artificial Sequence: example ZFP
QSGALRE

SEQ ID NO: 1989 - protein, 7 aa, Artificial Sequence
  Description of Artificial Sequence: example ZFP
RGDALTS

SEQ ID NO: 1990 - protein, 7 aa, Artificial Sequence
  Description of Artificial Sequence: example ZFP
RGDALTS

SEQ ID NO: 1991 - protein, 7 aa, Artificial Sequence
  Description of Artificial Sequence: example ZFP
RSDNLAR

SEQ ID NO: 1992 - protein, 7 aa, Artificial Sequence
  Description of Artificial Sequence: example ZFP
NRSHLAR

SEQ ID NO: 1993 - protein, 7 aa, Artificial Sequence
  Description of Artificial Sequence: example ZFP
RSDNLSR

SEQ ID NO: 1994 - protein, 7 aa, Artificial Sequence
  Description of Artificial Sequence: example ZFP
RSDHLRE

SEQ ID NO: 1995 - protein, 7 aa, Artificial Sequence
  Description of Artificial Sequence: example ZFP
RSDHLRE

SEQ ID NO: 1996 - protein, 7 aa, Artificial Sequence
  Description of Artificial Sequence: example ZFP
RGDALTS

SEQ ID NO: 1997 - protein, 7 aa, Artificial Sequence
  Description of Artificial Sequence: example ZFP
RGDALTS

SEQ ID NO: 1998 - protein, 7 aa, Artificial Sequence
  Description of Artificial Sequence: example ZFP
RSDERKR

SEQ ID NO: 1999 - protein, 7 aa, Artificial Sequence
  Description of Artificial Sequence: example ZFP
RSDTLKK

SEQ ID NO: 2000 - protein, 7 aa, Artificial Sequence
  Description of Artificial Sequence: example ZFP
RSDSLNQ

SEQ ID NO: 2001 - protein, 7 aa, Artificial Sequence
  Description of Artificial Sequence: example ZFP
RSDALSA

SEQ ID NO: 2002 - protein, 7 aa, Artificial Sequence
  Description of Artificial Sequence: example ZFP
RSDHLAE

SEQ ID NO: 2003 - protein, 7 aa, Artificial Sequence
  Description of Artificial Sequence: example ZFP
RSDHLRA

SEQ ID NO: 2004 - protein, 7 aa, Artificial Sequence
  Description of Artificial Sequence: example ZFP
RSDHLTR

SEQ ID NO: 2005 - protein, 7 aa, Artificial Sequence
  Description of Artificial Sequence: example ZFP
RGDALTS

SEQ ID NO: 2006 - protein, 7 aa, Artificial Sequence
  Description of Artificial Sequence: example ZFP
RSDALTS

SEQ ID NO: 2007 - protein, 7 aa, Artificial Sequence
  Description of Artificial Sequence: example ZFP
RGDALRS

SEQ ID NO: 2008 - protein, 7 aa, Artificial Sequence
  Description of Artificial Sequence: example ZFP
RSDHLTQ

SEQ ID NO: 2009 - protein, 7 aa, Artificial Sequence
  Description of Artificial Sequence: example ZFP
RSDNLAR

SEQ ID NO: 2010 - protein, 7 aa, Artificial Sequence
  Description of Artificial Sequence: example ZFP
RSDNLAR

SEQ ID NO: 2011 - protein, 7 aa, Artificial Sequence
  Description of Artificial Sequence: example ZFP
RSDERKR

SEQ ID NO: 2012 - protein, 7 aa, Artificial Sequence
  Description of Artificial Sequence: example ZFP
RSDERKR

SEQ ID NO: 2013 - DNA, 9 bp, Artificial Sequence
  Description of Artificial Sequence: example target DNA
atggaaggg

SEQ ID NO: 2014 - DNA, 9 bp, Artificial Sequence
  Description of Artificial Sequence: example target DNA
aagggtgac

SEQ ID NO: 2015 - DNA, 9 bp, Artificial Sequence
  Description of Artificial Sequence: example target DNA
gtggtggtg

SEQ ID NO: 2016 - DNA, 9 bp, Artificial Sequence
  Description of Artificial Sequence: example target DNA
aaggtctca

SEQ ID NO: 2017 - DNA, 9 bp, Artificial Sequence
  Description of Artificial Sequence: example target DNA
gtggaagaa

SEQ ID NO: 2018 - DNA, 9 bp, Artificial Sequence
  Description of Artificial Sequence: example target DNA
atggaagat

SEQ ID NO: 2019 - DNA, 9 bp, Artificial Sequence
  Description of Artificial Sequence: example target DNA
atgggtgca

SEQ ID NO: 2020 - DNA, 9 bp, Artificial Sequence
  Description of Artificial Sequence: example target DNA
tcagaggtg

SEQ ID NO: 2021 - DNA, 9 bp, Artificial Sequence
  Description of Artificial Sequence: example target DNA
caggaaaag

SEQ ID NO: 2022 - DNA, 9 bp, Artificial Sequence
  Description of Artificial Sequence: example target DNA
caggaaaag

SEQ ID NO: 2023 - DNA, 9 bp, Artificial Sequence
  Description of Artificial Sequence: example target DNA
gaggaagga

SEQ ID NO: 2024 - DNA, 9 bp, Artificial Sequence
  Description of Artificial Sequence: example target DNA
tcatagtag

SEQ ID NO: 2025 - DNA, 9 bp, Artificial Sequence
  Description of Artificial Sequence: example target DNA
gatgtggta

SEQ ID NO: 2026 - DNA, 9 bp, Artificial Sequence
  Description of Artificial Sequence: example target DNA
aaggtctca

SEQ ID NO: 2027 - DNA, 9 bp, Artificial Sequence
  Description of Artificial Sequence: example target DNA
aaggtctca

SEQ ID NO: 2028 - DNA, 9 bp, Artificial Sequence
  Description of Artificial Sequence: example target DNA
aaggtctca

SEQ ID NO: 2029 - DNA, 9 bp, Artificial Sequence
  Description of Artificial Sequence: example target DNA
gtggtggtg

SEQ ID NO: 2030 - DNA, 9 bp, Artificial Sequence
  Description of Artificial Sequence: example target DNA
caggttgag

SEQ ID NO: 2031 - DNA, 9 bp, Artificial Sequence
  Description of Artificial Sequence: example target DNA
caggttgag

SEQ ID NO: 2032 - DNA, 9 bp, Artificial Sequence
  Description of Artificial Sequence: example target DNA
caggtagat

SEQ ID NO: 2033 - DNA, 9 bp, Artificial Sequence
  Description of Artificial Sequence: example target DNA
gaggaagag

SEQ ID NO: 2034 - DNA, 9 bp, Artificial Sequence
  Description of Artificial Sequence: example target DNA
atggaaggg

SEQ ID NO: 2035 - DNA, 9 bp, Artificial Sequence
  Description of Artificial Sequence: example target DNA
gacgaggaa

SEQ ID NO: 2036 - DNA, 9 bp, Artificial Sequence
  Description of Artificial Sequence: example target DNA
atggaagat

SEQ ID NO: 2037 - DNA, 9 bp, Artificial Sequence
  Description of Artificial Sequence: example target DNA
atgggtgca

SEQ ID NO: 2038 - DNA, 9 bp, Artificial Sequence
  Description of Artificial Sequence: example target DNA
gtgggggct

SEQ ID NO: 2039 - DNA, 9 bp, Artificial Sequence
  Description of Artificial Sequence: example target DNA
gtgggggct

SEQ ID NO: 2040 - DNA, 9 bp, Artificial Sequence
  Description of Artificial Sequence: example target DNA
gggggctgg

SEQ ID NO: 2041 - DNA, 9 bp, Artificial Sequence
  Description of Artificial Sequence: example target DNA
gggggctgg

SEQ ID NO: 2042 - DNA, 9 bp, Artificial Sequence
  Description of Artificial Sequence: example target DNA
ggggctggg

SEQ ID NO: 2043 - DNA, 9 bp, Artificial Sequence
  Description of Artificial Sequence: example target DNA
ggggctggg

SEQ ID NO: 2044 - DNA, 9 bp, Artificial Sequence
  Description of Artificial Sequence: example target DNA
ggggctggg

SEQ ID NO: 2045 - DNA, 9 bp, Artificial Sequence
  Description of Artificial Sequence: example target DNA
ggggctggg

SEQ ID NO: 2046 - DNA, 9 bp, Artificial Sequence
  Description of Artificial Sequence: example target DNA
ggtgcggtg

SEQ ID NO: 2047 - DNA, 9 bp, Artificial Sequence
  Description of Artificial Sequence: example target DNA
ggtgcggtg

SEQ ID NO: 2048 - DNA, 9 bp, Artificial Sequence
  Description of Artificial Sequence: example target DNA
ggtgcggtg

SEQ ID NO: 2049 - DNA, 9 bp, Artificial Sequence
  Description of Artificial Sequence: example target DNA
ggtgcggtg

SEQ ID NO: 2050 - DNA, 9 bp, Artificial Sequence
  Description of Artificial Sequence: example target DNA
gaggcggca

SEQ ID NO: 2051 - DNA, 9 bp, Artificial Sequence
  Description of Artificial Sequence: example target DNA
gaggcggca

SEQ ID NO: 2052 - DNA, 9 bp, Artificial Sequence
  Description of Artificial Sequence: example target DNA
gcggcggtg

SEQ ID NO: 2053 - DNA, 9 bp, Artificial Sequence
  Description of Artificial Sequence: example target DNA
gcggcggcc

SEQ ID NO: 2054 - DNA, 9 bp, Artificial Sequence
  Description of Artificial Sequence: example target DNA
gaggaggcc

SEQ ID NO: 2055 - DNA, 9 bp, Artificial Sequence
  Description of Artificial Sequence: example target DNA
gaggaggcc

SEQ ID NO: 2056 - DNA, 9 bp, Artificial Sequence
  Description of Artificial Sequence: example target DNA
gaggccgca

SEQ ID NO: 2057 - DNA, 9 bp, Artificial Sequence
  Description of Artificial Sequence: example target DNA
gaggccgca

SEQ ID NO: 2058 - DNA, 9 bp, Artificial Sequence
  Description of Artificial Sequence: example target DNA
gtgggcgcc

SEQ ID NO: 2059 - DNA, 9 bp, Artificial Sequence
  Description of Artificial Sequence: example target DNA
gtgggcgcc

SEQ ID NO: 2060 - DNA, 9 bp, Artificial Sequence
  Description of Artificial Sequence: example target DNA
gtgggcgcc

SEQ ID NO: 2061 - DNA, 9 bp, Artificial Sequence
  Description of Artificial Sequence: example target DNA
gccgcggtc

SEQ ID NO: 2062 - DNA, 9 bp, Artificial Sequence
  Description of Artificial Sequence: example target DNA
gccgcggtc

SEQ ID NO: 2063 - DNA, 9 bp, Artificial Sequence
  Description of Artificial Sequence: example target DNA
caggccgct

SEQ ID NO: 2064 - DNA, 9 bp, Artificial Sequence
  Description of Artificial Sequence: example target DNA
caggccgct

SEQ ID NO: 2065 - DNA, 9 bp, Artificial Sequence
  Description of Artificial Sequence: example target DNA
ctggcagtg

SEQ ID NO: 2066 - DNA, 9 bp, Artificial Sequence
  Description of Artificial Sequence: example target DNA
ctggcagtg

SEQ ID NO: 2067 - DNA, 9 bp, Artificial Sequence
  Description of Artificial Sequence: example target DNA
ctggcggcg

SEQ ID NO: 2068 - DNA, 9 bp, Artificial Sequence
  Description of Artificial Sequence: example target DNA
ctggcggcg

SEQ ID NO: 2069 - DNA, 9 bp, Artificial Sequence
  Description of Artificial Sequence: example target DNA
caggcggcg

SEQ ID NO: 2070 - DNA, 9 bp, Artificial Sequence
  Description of Artificial Sequence: example target DNA
ccgggctgg

SEQ ID NO: 2071 - DNA, 9 bp, Artificial Sequence
  Description of Artificial Sequence: example target DNA
ccgggctgg

SEQ ID NO: 2072 - DNA, 9 bp, Artificial Sequence
  Description of Artificial Sequence: example target DNA
gacggcgag

SEQ ID NO: 2073 - DNA, 9 bp, Artificial Sequence
  Description of Artificial Sequence: example target DNA
gacggcgag

SEQ ID NO: 2074 - DNA, 9 bp, Artificial Sequence
  Description of Artificial Sequence: example target DNA
ggtgctgat

SEQ ID NO: 2075 - DNA, 9 bp, Artificial Sequence
  Description of Artificial Sequence: example target DNA
ggtgctgat

SEQ ID NO: 2076 - DNA, 9 bp, Artificial Sequence
  Description of Artificial Sequence: example target DNA
ggtgctgat

SEQ ID NO: 2077 - DNA, 9 bp, Artificial Sequence
  Description of Artificial Sequence: example target DNA
ggtgagggg

SEQ ID NO: 2078 - DNA, 9 bp, Artificial Sequence
  Description of Artificial Sequence: example target DNA
aaggtgggc

SEQ ID NO: 2079 - DNA, 9 bp, Artificial Sequence
  Description of Artificial Sequence: example target DNA
aaggtgggc

SEQ ID NO: 2080 - DNA, 9 bp, Artificial Sequence
  Description of Artificial Sequence: example target DNA
ggggctggg

SEQ ID NO: 2081 - DNA, 9 bp, Artificial Sequence
  Description of Artificial Sequence: example target DNA
gggggctgg

SEQ ID NO: 2082 - DNA, 9 bp, Artificial Sequence
  Description of Artificial Sequence: example target DNA
ggggaggaa

SEQ ID NO: 2083 - DNA, 9 bp, Artificial Sequence
  Description of Artificial Sequence: example target DNA
cagttggtc

SEQ ID NO: 2084 - DNA, 9 bp, Artificial Sequence
  Description of Artificial Sequence: example target DNA
agagaggct

SEQ ID NO: 2085 - DNA, 9 bp, Artificial Sequence
  Description of Artificial Sequence: example target DNA
acgtagtag

SEQ ID NO: 2086 - DNA, 9 bp, Artificial Sequence
  Description of Artificial Sequence: example target DNA
agagaggct

SEQ ID NO: 2087 - DNA, 9 bp, Artificial Sequence
  Description of Artificial Sequence: example target DNA
cagttggtc

SEQ ID NO: 2088 - DNA, 9 bp, Artificial Sequence
  Description of Artificial Sequence: example target DNA
ggagctgac

SEQ ID NO: 2089 - DNA, 9 bp, Artificial Sequence
  Description of Artificial Sequence: example target DNA
gcggaggag

SEQ ID NO: 2090 - DNA, 9 bp, Artificial Sequence
  Description of Artificial Sequence: example target DNA
acgtagtag

SEQ ID NO: 2091 - DNA, 9 bp, Artificial Sequence
  Description of Artificial Sequence: example target DNA
acgtagtag

SEQ ID NO: 2092 - DNA, 9 bp, Artificial Sequence
  Description of Artificial Sequence: example target DNA
gtaggggcg

SEQ ID NO: 2093 - DNA, 9 bp, Artificial Sequence
  Description of Artificial Sequence: example target DNA
gagagagat

SEQ ID NO: 2094 - DNA, 9 bp, Artificial Sequence
  Description of Artificial Sequence: example target DNA
gagatggag

SEQ ID NO: 2095 - DNA, 9 bp, Artificial Sequence
  Description of Artificial Sequence: example target DNA
gagatggag

SEQ ID NO: 2096 - DNA, 9 bp, Artificial Sequence
  Description of Artificial Sequence: example target DNA
gagagagat

SEQ ID NO: 2097 - DNA, 9 bp, Artificial Sequence
  Description of Artificial Sequence: example target DNA
ttggtggcg

SEQ ID NO: 2098 - DNA, 9 bp, Artificial Sequence
  Description of Artificial Sequence: example target DNA
gacgtaggg

SEQ ID NO: 2099 - DNA, 9 bp, Artificial Sequence
  Description of Artificial Sequence: example target DNA
gagagagat

SEQ ID NO: 2100 - DNA, 9 bp, Artificial Sequence
  Description of Artificial Sequence: example target DNA
gacgtaggg

SEQ ID NO: 2101 - DNA, 9 bp, Artificial Sequence
  Description of Artificial Sequence: example target DNA
gcggaggag

SEQ ID NO: 2102 - DNA, 9 bp, Artificial Sequence
  Description of Artificial Sequence: example target DNA
cagttggtc

SEQ ID NO: 2103 - DNA, 9 bp, Artificial Sequence
  Description of Artificial Sequence: example target DNA
ctggatgac

SEQ ID NO: 2104 - DNA, 9 bp, Artificial Sequence
  Description of Artificial Sequence: example target DNA
gtagtagaa

SEQ ID NO: 2105 - DNA, 9 bp, Artificial Sequence
  Description of Artificial Sequence: example target DNA
agggaggag

SEQ ID NO: 2106 - DNA, 9 bp, Artificial Sequence
  Description of Artificial Sequence: example target DNA
acgtagtag

SEQ ID NO: 2107 - DNA, 9 bp, Artificial Sequence
  Description of Artificial Sequence: example target DNA
gaggaggtg

SEQ ID NO: 2108 - DNA, 9 bp, Artificial Sequence
  Description of Artificial Sequence: example target DNA
ggggaggaa

SEQ ID NO: 2109 - DNA, 9 bp, Artificial Sequence
  Description of Artificial Sequence: example target DNA
gaggaggtg

SEQ ID NO: 2110 - DNA, 9 bp, Artificial Sequence
  Description of Artificial Sequence: example target DNA
gtggcttgt

SEQ ID NO: 2111 - DNA, 9 bp, Artificial Sequence
  Description of Artificial Sequence: example target DNA
gcggcggtg

SEQ ID NO: 2112 - DNA, 9 bp, Artificial Sequence
  Description of Artificial Sequence: example target DNA
ggtgctgat

SEQ ID NO: 2113 - DNA, 9 bp, Artificial Sequence
  Description of Artificial Sequence: example target DNA
gtgttcgtg

SEQ ID NO: 2114 - DNA, 9 bp, Artificial Sequence
  Description of Artificial Sequence: example target DNA
gtgttcgtg

SEQ ID NO: 2115 - DNA, 9 bp, Artificial Sequence
  Description of Artificial Sequence: example target DNA
gtgttcgtg

SEQ ID NO: 2116 - DNA, 9 bp, Artificial Sequence
  Description of Artificial Sequence: example target DNA
gtaggggca

SEQ ID NO: 2117 - DNA, 9 bp, Artificial Sequence
  Description of Artificial Sequence: example target DNA
gtaggggca

SEQ ID NO: 2118 - DNA, 9 bp, Artificial Sequence
  Description of Artificial Sequence: example target DNA
ggggctggg

SEQ ID NO: 2119 - DNA, 9 bp, Artificial Sequence
  Description of Artificial Sequence: example target DNA
ggggctggg

SEQ ID NO: 2120 - DNA, 9 bp, Artificial Sequence
  Description of Artificial Sequence: example target DNA
tcatagtag

SEQ ID NO: 2121 - DNA, 9 bp, Artificial Sequence
  Description of Artificial Sequence: example target DNA
cagggagag

SEQ ID NO: 2122 - DNA, 9 bp, Artificial Sequence
  Description of Artificial Sequence: example target DNA
cagggagag

SEQ ID NO: 2123 - DNA, 9 bp, Artificial Sequence
  Description of Artificial Sequence: example target DNA
ggggcagga

SEQ ID NO: 2124 - DNA, 9 bp, Artificial Sequence
  Description of Artificial Sequence: example target DNA
ggggcagga

SEQ ID NO: 2125 - DNA, 9 bp, Artificial Sequence
  Description of Artificial Sequence: example target DNA
ggggcagga

SEQ ID NO: 2126 - DNA, 9 bp, Artificial Sequence
  Description of Artificial Sequence: example target DNA
caggctgta

SEQ ID NO: 2127 - DNA, 9 bp, Artificial Sequence
  Description of Artificial Sequence: example target DNA
caggctgta

SEQ ID NO: 2128 - DNA, 9 bp, Artificial Sequence
  Description of Artificial Sequence: example target DNA
caggctgta

SEQ ID NO: 2129 - DNA, 9 bp, Artificial Sequence
  Description of Artificial Sequence: example target DNA
gaggctgag

SEQ ID NO: 2130 - DNA, 9 bp, Artificial Sequence
  Description of Artificial Sequence: example target DNA
taggacggg

SEQ ID NO: 2131 - DNA, 9 bp, Artificial Sequence
  Description of Artificial Sequence: example target DNA
taggacggg

SEQ ID NO: 2132 - DNA, 9 bp, Artificial Sequence
  Description of Artificial Sequence: example target DNA
gctgcaggg

SEQ ID NO: 2133 - DNA, 9 bp, Artificial Sequence
  Description of Artificial Sequence: example target DNA
gctgcaggg

SEQ ID NO: 2134 - DNA, 9 bp, Artificial Sequence
  Description of Artificial Sequence: example target DNA
gctgcaggg

SEQ ID NO: 2135 - DNA, 9 bp, Artificial Sequence
  Description of Artificial Sequence: example target DNA
gctgcaggg

SEQ ID NO: 2136 - DNA, 9 bp, Artificial Sequence
  Description of Artificial Sequence: example target DNA
ggggccgcg

SEQ ID NO: 2137 - DNA, 9 bp, Artificial Sequence
  Description of Artificial Sequence: example target DNA
ggggccgcg

SEQ ID NO: 2138 - DNA, 9 bp, Artificial Sequence
  Description of Artificial Sequence: example target DNA
gcggaggcc

SEQ ID NO: 2139 - DNA, 9 bp, Artificial Sequence
  Description of Artificial Sequence: example target DNA
gttgcgggg

SEQ ID NO: 2140 - DNA, 9 bp, Artificial Sequence
  Description of Artificial Sequence: example target DNA
gttgcgggg

SEQ ID NO: 2141 - DNA, 9 bp, Artificial Sequence
  Description of Artificial Sequence: example target DNA
gttgcgggg

SEQ ID NO: 2142 - DNA, 9 bp, Artificial Sequence
  Description of Artificial Sequence: example target DNA
gcggcagtg

SEQ ID NO: 2143 - DNA, 9 bp, Artificial Sequence
  Description of Artificial Sequence: example target DNA
tggggcggg

SEQ ID NO: 2144 - DNA, 9 bp, Artificial Sequence
  Description of Artificial Sequence: example target DNA
gagggcggt

SEQ ID NO: 2145 - DNA, 9 bp, Artificial Sequence
  Description of Artificial Sequence: example target DNA
gagggcggt

SEQ ID NO: 2146 - DNA, 9 bp, Artificial Sequence
  Description of Artificial Sequence: example target DNA
gcagggggc

SEQ ID NO: 2147 - DNA, 9 bp, Artificial Sequence
  Description of Artificial Sequence: example target DNA
gcaggcggt

SEQ ID NO: 2148 - DNA, 9 bp, Artificial Sequence
  Description of Artificial Sequence: example target DNA
ggggcaggc

SEQ ID NO: 2149 - DNA, 9 bp, Artificial Sequence
  Description of Artificial Sequence: example target DNA
ggggcaggc

SEQ ID NO: 2150 - DNA, 9 bp, Artificial Sequence
  Description of Artificial Sequence: example target DNA
ggattggct

SEQ ID NO: 2151 - DNA, 9 bp, Artificial Sequence
  Description of Artificial Sequence: example target DNA
ggattggct

SEQ ID NO: 2152 - DNA, 9 bp, Artificial Sequence
  Description of Artificial Sequence: example target DNA
gtgttggcg

SEQ ID NO: 2153 - DNA, 9 bp, Artificial Sequence
  Description of Artificial Sequence: example target DNA
gcggcagcg

SEQ ID NO: 2154 - DNA, 9 bp, Artificial Sequence
  Description of Artificial Sequence: example target DNA
gcggcagcg

SEQ ID NO: 2155 - DNA, 9 bp, Artificial Sequence
  Description of Artificial Sequence: example target DNA
gggggggcc

SEQ ID NO: 2156 - DNA, 9 bp, Artificial Sequence
  Description of Artificial Sequence: example target DNA
gggggggcc

SEQ ID NO: 2157 - DNA, 9 bp, Artificial Sequence
  Description of Artificial Sequence: example target DNA
ctggaggcg

SEQ ID NO: 2158 - DNA, 9 bp, Artificial Sequence
  Description of Artificial Sequence: example target DNA
ggggaggtg

SEQ ID NO: 2159 - DNA, 9 bp, Artificial Sequence
  Description of Artificial Sequence: example target DNA
ctggcggcg

SEQ ID NO: 2160 - DNA, 9 bp, Artificial Sequence
  Description of Artificial Sequence: example target DNA
ctggtggca

SEQ ID NO: 2161 - DNA, 9 bp, Artificial Sequence
  Description of Artificial Sequence: example target DNA
ggtgaggcg

SEQ ID NO: 2162 - DNA, 9 bp, Artificial Sequence
  Description of Artificial Sequence: example target DNA
ggtgaggcg

SEQ ID NO: 2163 - DNA, 9 bp, Artificial Sequence
  Description of Artificial Sequence: example target DNA
ggggctggg

SEQ ID NO: 2164 - DNA, 9 bp, Artificial Sequence
  Description of Artificial Sequence: example target DNA
cgggcggcc

SEQ ID NO: 2165 - DNA, 9 bp, Artificial Sequence
  Description of Artificial Sequence: example target DNA
cgggcggcc

SEQ ID NO: 2166 - DNA, 9 bp, Artificial Sequence
  Description of Artificial Sequence: example target DNA
gacgaggct

SEQ ID NO: 2167 - DNA, 9 bp, Artificial Sequence
  Description of Artificial Sequence: example target DNA
aaggcgctg

SEQ ID NO: 2168 - DNA, 9 bp, Artificial Sequence
  Description of Artificial Sequence: example target DNA
gtagaggac

SEQ ID NO: 2169 - DNA, 9 bp, Artificial Sequence
  Description of Artificial Sequence: example target DNA
gccttggct

SEQ ID NO: 2170 - DNA, 9 bp, Artificial Sequence
  Description of Artificial Sequence: example target DNA
gcggagtcg

SEQ ID NO: 2171 - DNA, 9 bp, Artificial Sequence
  Description of Artificial Sequence: example target DNA
gcggttggt

SEQ ID NO: 2172 - DNA, 9 bp, Artificial Sequence
  Description of Artificial Sequence: example target DNA
gggggagcc

SEQ ID NO: 2173 - DNA, 9 bp, Artificial Sequence
  Description of Artificial Sequence: example target DNA
gggggagcc

SEQ ID NO: 2174 - DNA, 9 bp, Artificial Sequence
  Description of Artificial Sequence: example target DNA
gaggccgaa

SEQ ID NO: 2175 - DNA, 9 bp, Artificial Sequence
  Description of Artificial Sequence: example target DNA
gccggggag

SEQ ID NO: 2176 - DNA, 9 bp, Artificial Sequence
  Description of Artificial Sequence: example target DNA
gcggagtcg

SEQ ID NO: 2177 - DNA, 9 bp, Artificial Sequence
  Description of Artificial Sequence: example target DNA
gtgttggta

SEQ ID NO: 2178 - DNA, 9 bp, Artificial Sequence
  Description of Artificial Sequence: example target DNA
atgggagtt

SEQ ID NO: 2179 - DNA, 9 bp, Artificial Sequence
  Description of Artificial Sequence: example target DNA
aaggcagaa

SEQ ID NO: 2180 - DNA, 9 bp, Artificial Sequence
  Description of Artificial Sequence: example target DNA
aaggcagaa

SEQ ID NO: 2181 - DNA, 9 bp, Artificial Sequence
  Description of Artificial Sequence: example target DNA
cgggcagct

SEQ ID NO: 2182 - DNA, 9 bp, Artificial Sequence
  Description of Artificial Sequence: example target DNA
ctggcagcc

SEQ ID NO: 2183 - DNA, 9 bp, Artificial Sequence
  Description of Artificial Sequence: example target DNA
ctggcagcc

SEQ ID NO: 2184 - DNA, 9 bp, Artificial Sequence
  Description of Artificial Sequence: example target DNA
gcgggagtt

SEQ ID NO: 2185 - DNA, 9 bp, Artificial Sequence
  Description of Artificial Sequence: example target DNA
caggctgga

SEQ ID NO: 2186 - DNA, 9 bp, Artificial Sequence
  Description of Artificial Sequence: example target DNA
aggggagcc

SEQ ID NO: 2187 - DNA, 9 bp, Artificial Sequence
  Description of Artificial Sequence: example target DNA
aggggagcc

SEQ ID NO: 2188 - DNA, 9 bp, Artificial Sequence
  Description of Artificial Sequence: example target DNA
ctggtaggg

SEQ ID NO: 2189 - DNA, 9 bp, Artificial Sequence
  Description of Artificial Sequence: example target DNA
ctggtaggg

SEQ ID NO: 2190 - DNA, 9 bp, Artificial Sequence
  Description of Artificial Sequence: example target DNA
ctgggggca

SEQ ID NO: 2191 - DNA, 9 bp, Artificial Sequence
  Description of Artificial Sequence: example target DNA
caggttgat

SEQ ID NO: 2192 - DNA, 9 bp, Artificial Sequence
  Description of Artificial Sequence: example target DNA
caggttgat

SEQ ID NO: 2193 - DNA, 9 bp, Artificial Sequence
  Description of Artificial Sequence: example target DNA
ccggaagcg

SEQ ID NO: 2194 - DNA, 9 bp, Artificial Sequence
  Description of Artificial Sequence: example target DNA
gcagcgcag

SEQ ID NO: 2195 - DNA, 9 bp, Artificial Sequence
  Description of Artificial Sequence: example target DNA
tagggagtc

SEQ ID NO: 2196 - DNA, 9 bp, Artificial Sequence
  Description of Artificial Sequence: example target DNA
tgggagggt

SEQ ID NO: 2197 - DNA, 9 bp, Artificial Sequence
  Description of Artificial Sequence: example target DNA
agggacgcg

SEQ ID NO: 2198 - DNA, 9 bp, Artificial Sequence
  Description of Artificial Sequence: example target DNA
ctggtggcc

SEQ ID NO: 2199 - DNA, 9 bp, Artificial Sequence
  Description of Artificial Sequence: example target DNA
ctggtggcc

SEQ ID NO: 2200 - DNA, 9 bp, Artificial Sequence
  Description of Artificial Sequence: example target DNA
taggaagca

SEQ ID NO: 2201 - DNA, 9 bp, Artificial Sequence
  Description of Artificial Sequence: example target DNA
gtggatgga

SEQ ID NO: 2202 - DNA, 9 bp, Artificial Sequence
  Description of Artificial Sequence: example target DNA
ttggctatg

SEQ ID NO: 2203 - DNA, 9 bp, Artificial Sequence
  Description of Artificial Sequence: example target DNA
cagggggtt

SEQ ID NO: 2204 - DNA, 9 bp, Artificial Sequence
  Description of Artificial Sequence: example target DNA
aaggtcgcc

SEQ ID NO: 2205 - DNA, 9 bp, Artificial Sequence
  Description of Artificial Sequence: example target DNA
ggtgcagac

SEQ ID NO: 2206 - DNA, 9 bp, Artificial Sequence
  Description of Artificial Sequence: example target DNA
gtgggagcc

SEQ ID NO: 2207 - DNA, 9 bp, Artificial Sequence
  Description of Artificial Sequence: example target DNA
ggggctgga

SEQ ID NO: 2208 - DNA, 9 bp, Artificial Sequence
  Description of Artificial Sequence: example target DNA
ggggctgga

SEQ ID NO: 2209 - DNA, 9 bp, Artificial Sequence
  Description of Artificial Sequence: example target DNA
tgggggtgg

SEQ ID NO: 2210 - DNA, 9 bp, Artificial Sequence
  Description of Artificial Sequence: example target DNA
gcggcgggg

SEQ ID NO: 2211 - DNA, 9 bp, Artificial Sequence
  Description of Artificial Sequence: example target DNA
ccgggagtg

SEQ ID NO: 2212 - DNA, 9 bp, Artificial Sequence
  Description of Artificial Sequence: example target DNA
ccgggagtg

SEQ ID NO: 2213 - DNA, 9 bp, Artificial Sequence
  Description of Artificial Sequence: example target DNA
cagggggta

SEQ ID NO: 2214 - DNA, 9 bp, Artificial Sequence
  Description of Artificial Sequence: example target DNA
acggccgag

SEQ ID NO: 2215 - DNA, 9 bp, Artificial Sequence
  Description of Artificial Sequence: example target DNA
aagggtgcg

SEQ ID NO: 2216 - DNA, 9 bp, Artificial Sequence
  Description of Artificial Sequence: example target DNA
atggacttg

SEQ ID NO: 2217 - DNA, 9 bp, Artificial Sequence
  Description of Artificial Sequence: example target DNA
ttggaggag

SEQ ID NO: 2218 - DNA, 9 bp, Artificial Sequence
  Description of Artificial Sequence: example target DNA
ttggaggag

SEQ ID NO: 2219 - DNA, 9 bp, Artificial Sequence
  Description of Artificial Sequence: example target DNA
gaagaggca

SEQ ID NO: 2220 - DNA, 9 bp, Artificial Sequence
  Description of Artificial Sequence: example target DNA
gtagtatgg

SEQ ID NO: 2221 - DNA, 9 bp, Artificial Sequence
  Description of Artificial Sequence: example target DNA
aaggctgga

SEQ ID NO: 2222 - DNA, 9 bp, Artificial Sequence
  Description of Artificial Sequence: example target DNA
aaggctgga

SEQ ID NO: 2223 - DNA, 9 bp, Artificial Sequence
  Description of Artificial Sequence: example target DNA
ctggcgtag

SEQ ID NO: 2224 - DNA, 9 bp, Artificial Sequence
  Description of Artificial Sequence: example target DNA
atggttgaa

SEQ ID NO: 2225 - DNA, 9 bp, Artificial Sequence
  Description of Artificial Sequence: example target DNA
atggttgaa

SEQ ID NO: 2226 - DNA, 9 bp, Artificial Sequence
  Description of Artificial Sequence: example target DNA
aggggagaa

SEQ ID NO: 2227 - DNA, 9 bp, Artificial Sequence
  Description of Artificial Sequence: example target DNA
aggggagaa

SEQ ID NO: 2228 - DNA, 9 bp, Artificial Sequence
  Description of Artificial Sequence: example target DNA
tgggaaggc

SEQ ID NO: 2229 - DNA, 9 bp, Artificial Sequence
  Description of Artificial Sequence: example target DNA
gaggccggc

SEQ ID NO: 2230 - DNA, 9 bp, Artificial Sequence
  Description of Artificial Sequence: example target DNA
gtgttggta

SEQ ID NO: 2231 - DNA, 9 bp, Artificial Sequence
  Description of Artificial Sequence: example target DNA
gtgtgagcc

SEQ ID NO: 2232 - DNA, 9 bp, Artificial Sequence
  Description of Artificial Sequence: example target DNA
gtgtgagcc

SEQ ID NO: 2233 - DNA, 9 bp, Artificial Sequence
  Description of Artificial Sequence: example target DNA
gcgaaggtg

SEQ ID NO: 2234 - DNA, 9 bp, Artificial Sequence
  Description of Artificial Sequence: example target DNA
gcgaaggtg

SEQ ID NO: 2235 - DNA, 9 bp, Artificial Sequence
  Description of Artificial Sequence: example target DNA
gcgaaggtg

SEQ ID NO: 2236 - DNA, 9 bp, Artificial Sequence
  Description of Artificial Sequence: example target DNA
aaggcgctg

SEQ ID NO: 2237 - DNA, 9 bp, Artificial Sequence
  Description of Artificial Sequence: example target DNA
gtagaggac

SEQ ID NO: 2238 - DNA, 9 bp, Artificial Sequence
  Description of Artificial Sequence: example target DNA
gccttggct

SEQ ID NO: 2239 - DNA, 9 bp, Artificial Sequence
  Description of Artificial Sequence: example target DNA
gcggagtcg

SEQ ID NO: 2240 - DNA, 9 bp, Artificial Sequence
  Description of Artificial Sequence: example target DNA
gccggggag

SEQ ID NO: 2241 - DNA, 9 bp, Artificial Sequence
  Description of Artificial Sequence: example target DNA
gctgaaggg

SEQ ID NO: 2242 - DNA, 9 bp, Artificial Sequence
  Description of Artificial Sequence: example target DNA
gctgaaggg

SEQ ID NO: 2243 - DNA, 9 bp, Artificial Sequence
  Description of Artificial Sequence: example target DNA
aaggtcgcc

SEQ ID NO: 2244 - DNA, 9 bp, Artificial Sequence
  Description of Artificial Sequence: example target DNA
gtgggagcc

SEQ ID NO: 2245 - DNA, 9 bp, Artificial Sequence
  Description of Artificial Sequence: example target DNA
ccgggcgca

SEQ ID NO: 2246 - DNA, 9 bp, Artificial Sequence
  Description of Artificial Sequence: example target DNA
gaggatggc

SEQ ID NO: 2247 - DNA, 9 bp, Artificial Sequence
  Description of Artificial Sequence: example target DNA
gcagcgcag

SEQ ID NO: 2248 - DNA, 9 bp, Artificial Sequence
  Description of Artificial Sequence: example target DNA
aaggaaaga

SEQ ID NO: 2249 - DNA, 9 bp, Artificial Sequence
  Description of Artificial Sequence: example target DNA
ttggctatg

SEQ ID NO: 2250 - DNA, 9 bp, Artificial Sequence
  Description of Artificial Sequence: example target DNA
caggaaggc

SEQ ID NO: 2251 - DNA, 9 bp, Artificial Sequence
  Description of Artificial Sequence: example target DNA
caggaaggc

SEQ ID NO: 2252 - DNA, 9 bp, Artificial Sequence
  Description of Artificial Sequence: example target DNA
aaggaaaga

SEQ ID NO: 2253 - DNA, 9 bp, Artificial Sequence
  Description of Artificial Sequence: example target DNA
aaggaaaga

SEQ ID NO: 2254 - DNA, 9 bp, Artificial Sequence
  Description of Artificial Sequence: example target DNA
gccgaggtg

SEQ ID NO: 2255 - DNA, 9 bp, Artificial Sequence
  Description of Artificial Sequence: example target DNA
ctggtgggc

SEQ ID NO: 2256 - DNA, 9 bp, Artificial Sequence
  Description of Artificial Sequence: example target DNA
gtagtatgg

SEQ ID NO: 2257 - DNA, 9 bp, Artificial Sequence
  Description of Artificial Sequence: example target DNA
atggttgaa

SEQ ID NO: 2258 - DNA, 9 bp, Artificial Sequence
  Description of Artificial Sequence: example target DNA
atggcagtg

SEQ ID NO: 2259 - DNA, 9 bp, Artificial Sequence
  Description of Artificial Sequence: example target DNA
atggcagtg

SEQ ID NO: 2260 - DNA, 9 bp, Artificial Sequence
  Description of Artificial Sequence: example target DNA
atggcagtg

SEQ ID NO: 2261 - DNA, 9 bp, Artificial Sequence
  Description of Artificial Sequence: example target DNA
atggcagtg

SEQ ID NO: 2262 - DNA, 9 bp, Artificial Sequence
  Description of Artificial Sequence: example target DNA
gagaaggtg

SEQ ID NO: 2263 - DNA, 9 bp, Artificial Sequence
  Description of Artificial Sequence: example target DNA
gagaaggtg

SEQ ID NO: 2264 - DNA, 9 bp, Artificial Sequence
  Description of Artificial Sequence: example target DNA
gaaggtgcc

SEQ ID NO: 2265 - DNA, 9 bp, Artificial Sequence
  Description of Artificial Sequence: example target DNA
atggagaag

SEQ ID NO: 2266 - DNA, 9 bp, Artificial Sequence
  Description of Artificial Sequence: example target DNA
atggagaag

SEQ ID NO: 2267 - DNA, 9 bp, Artificial Sequence
  Description of Artificial Sequence: example target DNA
atggagaag

SEQ ID NO: 2268 - DNA, 9 bp, Artificial Sequence
  Description of Artificial Sequence: example target DNA
ctggagtac

SEQ ID NO: 2269 - DNA, 9 bp, Artificial Sequence
  Description of Artificial Sequence: example target DNA
ggagtactg

SEQ ID NO: 2270 - DNA, 9 bp, Artificial Sequence
  Description of Artificial Sequence: example target DNA
ggagtactg

SEQ ID NO: 2271 - DNA, 9 bp, Artificial Sequence
  Description of Artificial Sequence: example target DNA
cgggcagct

SEQ ID NO: 2272 - DNA, 9 bp, Artificial Sequence
  Description of Artificial Sequence: example target DNA
gcgggagtt

SEQ ID NO: 2273 - DNA, 9 bp, Artificial Sequence
  Description of Artificial Sequence: example target DNA
caggctgga

SEQ ID NO: 2274 - DNA, 9 bp, Artificial Sequence
  Description of Artificial Sequence: example target DNA
ccggaagcg

SEQ ID NO: 2275 - DNA, 9 bp, Artificial Sequence
  Description of Artificial Sequence: example target DNA
gcagcgcag

SEQ ID NO: 2276 - DNA, 9 bp, Artificial Sequence
  Description of Artificial Sequence: example target DNA
cagggggtt

SEQ ID NO: 2277 - DNA, 9 bp, Artificial Sequence
  Description of Artificial Sequence: example target DNA
gaagaagag

SEQ ID NO: 2278 - DNA, 9 bp, Artificial Sequence
  Description of Artificial Sequence: example target DNA
atgggagtt

SEQ ID NO: 2279 - DNA, 9 bp, Artificial Sequence
  Description of Artificial Sequence: example target DNA
gtgggggct

SEQ ID NO: 2280 - DNA, 9 bp, Artificial Sequence
  Description of Artificial Sequence: example target DNA
gaagaggca

SEQ ID NO: 2281 - DNA, 9 bp, Artificial Sequence
  Description of Artificial Sequence: example target DNA
gcggtgagg

SEQ ID NO: 2282 - DNA, 9 bp, Artificial Sequence
  Description of Artificial Sequence: example target DNA
aaggaaagg

SEQ ID NO: 2283 - DNA, 9 bp, Artificial Sequence
  Description of Artificial Sequence: example target DNA
aaggaaagg

SEQ ID NO: 2284 - DNA, 9 bp, Artificial Sequence
  Description of Artificial Sequence: example target DNA
aaggaaagg

SEQ ID NO: 2285 - DNA, 9 bp, Artificial Sequence
  Description of Artificial Sequence: example target DNA
caggagggc

SEQ ID NO: 2286 - DNA, 9 bp, Artificial Sequence
  Description of Artificial Sequence: example target DNA
atggacttg

SEQ ID NO: 2287 - DNA, 9 bp, Artificial Sequence
  Description of Artificial Sequence: example target DNA
atggacttg

SEQ ID NO: 2288 - DNA, 9 bp, Artificial Sequence
  Description of Artificial Sequence: example target DNA
gaatagggg

SEQ ID NO: 2289 - DNA, 9 bp, Artificial Sequence
  Description of Artificial Sequence: example target DNA
acggccgag

SEQ ID NO: 2290 - DNA, 9 bp, Artificial Sequence
  Description of Artificial Sequence: example target DNA
aagggtgcg

SEQ ID NO: 2291 - DNA, 9 bp, Artificial Sequence
  Description of Artificial Sequence: example target DNA
aagggagac

SEQ ID NO: 2292 - DNA, 9 bp, Artificial Sequence
  Description of Artificial Sequence: example target DNA
aagggagac

SEQ ID NO: 2293 - DNA, 9 bp, Artificial Sequence
  Description of Artificial Sequence: example target DNA
tgggacctg

SEQ ID NO: 2294 - DNA, 9 bp, Artificial Sequence
  Description of Artificial Sequence: example target DNA
tgggacctg

SEQ ID NO: 2295 - DNA, 9 bp, Artificial Sequence
  Description of Artificial Sequence: example target DNA
gagtaggca

SEQ ID NO: 2296 - DNA, 9 bp, Artificial Sequence
  Description of Artificial Sequence: example target DNA
gagtaggca

SEQ ID NO: 2297 - DNA, 9 bp, Artificial Sequence
  Description of Artificial Sequence: example target DNA
gaaggagag

SEQ ID NO: 2298 - DNA, 9 bp, Artificial Sequence
  Description of Artificial Sequence: example target DNA
ctggatgtt

SEQ ID NO: 2299 - DNA, 9 bp, Artificial Sequence
  Description of Artificial Sequence: example target DNA
caggacgtg

SEQ ID NO: 2300 - DNA, 9 bp, Artificial Sequence
  Description of Artificial Sequence: example target DNA
ggggaggca

SEQ ID NO: 2301 - DNA, 9 bp, Artificial Sequence
  Description of Artificial Sequence: example target DNA
gaggtgtca

SEQ ID NO: 2302 - DNA, 9 bp, Artificial Sequence
  Description of Artificial Sequence: example target DNA
ggggttgaa

SEQ ID NO: 2303 - DNA, 9 bp, Artificial Sequence
  Description of Artificial Sequence: example target DNA
ggggttgaa

SEQ ID NO: 2304 - DNA, 9 bp, Artificial Sequence
  Description of Artificial Sequence: example target DNA
gtcgcggtg

SEQ ID NO: 2305 - DNA, 9 bp, Artificial Sequence
  Description of Artificial Sequence: example target DNA
gtcgcggtg

SEQ ID NO: 2306 - DNA, 9 bp, Artificial Sequence
  Description of Artificial Sequence: example target DNA
gtggttgcg

SEQ ID NO: 2307 - DNA, 9 bp, Artificial Sequence
  Description of Artificial Sequence: example target DNA
gtggttgcg

SEQ ID NO: 2308 - DNA, 9 bp, Artificial Sequence
  Description of Artificial Sequence: example target DNA
gtctaggta

SEQ ID NO: 2309 - DNA, 9 bp, Artificial Sequence
  Description of Artificial Sequence: example target DNA
ccgggagcg

SEQ ID NO: 2310 - DNA, 9 bp, Artificial Sequence
  Description of Artificial Sequence: example target DNA
gaaggagag

SEQ ID NO: 2311 - DNA, 9 bp, Artificial Sequence
  Description of Artificial Sequence: example target DNA
ccggctgga

SEQ ID NO: 2312 - DNA, 9 bp, Artificial Sequence
  Description of Artificial Sequence: example target DNA
ccgggagcg

SEQ ID NO: 2313 - DNA, 9 bp, Artificial Sequence
  Description of Artificial Sequence: example target DNA
acgtagtag

SEQ ID NO: 2314 - DNA, 9 bp, Artificial Sequence
  Description of Artificial Sequence: example target DNA
ggggaggat

SEQ ID NO: 2315 - DNA, 9 bp, Artificial Sequence
  Description of Artificial Sequence: example target DNA
ggggaggat

SEQ ID NO: 2316 - DNA, 9 bp, Artificial Sequence
  Description of Artificial Sequence: example target DNA
ggggaggat

SEQ ID NO: 2317 - DNA, 9 bp, Artificial Sequence
  Description of Artificial Sequence: example target DNA
gagtgtgtg

SEQ ID NO: 2318 - DNA, 9 bp, Artificial Sequence
  Description of Artificial Sequence: example target DNA
gagtgtgtg

SEQ ID NO: 2319 - DNA, 9 bp, Artificial Sequence
  Description of Artificial Sequence: example target DNA
tgcggggca

SEQ ID NO: 2320 - DNA, 9 bp, Artificial Sequence
  Description of Artificial Sequence: example target DNA
tgcggggca

SEQ ID NO: 2321 - DNA, 9 bp, Artificial Sequence
  Description of Artificial Sequence: example target DNA
tgcggggca

SEQ ID NO: 2322 - DNA, 9 bp, Artificial Sequence
  Description of Artificial Sequence: example target DNA
aagttggtt

SEQ ID NO: 2323 - DNA, 9 bp, Artificial Sequence
  Description of Artificial Sequence: example target DNA
aagttggtt

SEQ ID NO: 2324 - DNA, 9 bp, Artificial Sequence
  Description of Artificial Sequence: example target DNA
cagggtggc

SEQ ID NO: 2325 - DNA, 9 bp, Artificial Sequence
  Description of Artificial Sequence: example target DNA
taggcagtc

SEQ ID NO: 2326 - DNA, 9 bp, Artificial Sequence
  Description of Artificial Sequence: example target DNA
ctgttggct

SEQ ID NO: 2327 - DNA, 9 bp, Artificial Sequence
  Description of Artificial Sequence: example target DNA
ctgttggct

SEQ ID NO: 2328 - DNA, 9 bp, Artificial Sequence
  Description of Artificial Sequence: example target DNA
ttggatgga

SEQ ID NO: 2329 - DNA, 9 bp, Artificial Sequence
  Description of Artificial Sequence: example target DNA
gtggcactg

SEQ ID NO: 2330 - DNA, 9 bp, Artificial Sequence
  Description of Artificial Sequence: example target DNA
caggagtcc

SEQ ID NO: 2331 - DNA, 9 bp, Artificial Sequence
  Description of Artificial Sequence: example target DNA
caggagtcc

SEQ ID NO: 2332 - DNA, 9 bp, Artificial Sequence
  Description of Artificial Sequence: example target DNA
gcatgggaa

SEQ ID NO: 2333 - DNA, 9 bp, Artificial Sequence
  Description of Artificial Sequence: example target DNA
gcatgggaa

SEQ ID NO: 2334 - DNA, 9 bp, Artificial Sequence
  Description of Artificial Sequence: example target DNA
taggaagag

SEQ ID NO: 2335 - DNA, 9 bp, Artificial Sequence
  Description of Artificial Sequence: example target DNA
gaagagggg

SEQ ID NO: 2336 - DNA, 9 bp, Artificial Sequence
  Description of Artificial Sequence: example target DNA
gagtaggca

SEQ ID NO: 2337 - DNA, 9 bp, Artificial Sequence
  Description of Artificial Sequence: example target DNA
gaggtgtca

SEQ ID NO: 2338 - DNA, 9 bp, Artificial Sequence
  Description of Artificial Sequence: example target DNA
tcggtcgcc

SEQ ID NO: 2339 - DNA, 9 bp, Artificial Sequence
  Description of Artificial Sequence: example target DNA
gtggtagga

SEQ ID NO: 2340 - DNA, 9 bp, Artificial Sequence
  Description of Artificial Sequence: example target DNA
cagggtggc

SEQ ID NO: 2341 - DNA, 9 bp, Artificial Sequence
  Description of Artificial Sequence: example target DNA
taggcagtc

SEQ ID NO: 2342 - DNA, 9 bp, Artificial Sequence
  Description of Artificial Sequence: example target DNA
gtggtgata

SEQ ID NO: 2343 - DNA, 9 bp, Artificial Sequence
  Description of Artificial Sequence: example target DNA
gtggtgata

SEQ ID NO: 2344 - DNA, 9 bp, Artificial Sequence
  Description of Artificial Sequence: example target DNA
ttggatgga

SEQ ID NO: 2345 - DNA, 9 bp, Artificial Sequence
  Description of Artificial Sequence: example target DNA
aaggtaggt

SEQ ID NO: 2346 - DNA, 9 bp, Artificial Sequence
  Description of Artificial Sequence: example target DNA
aaggtaggt

SEQ ID NO: 2347 - DNA, 9 bp, Artificial Sequence
  Description of Artificial Sequence: example target DNA
caggagtcc

SEQ ID NO: 2348 - DNA, 9 bp, Artificial Sequence
  Description of Artificial Sequence: example target DNA
caggagtcc

SEQ ID NO: 2349 - DNA, 9 bp, Artificial Sequence
  Description of Artificial Sequence: example target DNA
taggaagag

SEQ ID NO: 2350 - DNA, 9 bp, Artificial Sequence
  Description of Artificial Sequence: example target DNA
caggacgtg

SEQ ID NO: 2351 - DNA, 9 bp, Artificial Sequence
  Description of Artificial Sequence: example target DNA
gtctaggta

SEQ ID NO: 2352 - DNA, 9 bp, Artificial Sequence
  Description of Artificial Sequence: example target DNA
ccggctgga

SEQ ID NO: 2353 - DNA, 9 bp, Artificial Sequence
  Description of Artificial Sequence: example target DNA
taggagttt

SEQ ID NO: 2354 - DNA, 9 bp, Artificial Sequence
  Description of Artificial Sequence: example target DNA
ctggccttg

SEQ ID NO: 2355 - DNA, 9 bp, Artificial Sequence
  Description of Artificial Sequence: example target DNA
tgggcagcc

SEQ ID NO: 2356 - DNA, 9 bp, Artificial Sequence
  Description of Artificial Sequence: example target DNA
taggagttt

SEQ ID NO: 2357 - DNA, 9 bp, Artificial Sequence
  Description of Artificial Sequence: example target DNA
taggagttt

SEQ ID NO: 2358 - DNA, 9 bp, Artificial Sequence
  Description of Artificial Sequence: example target DNA
tgggcagcc

SEQ ID NO: 2359 - DNA, 9 bp, Artificial Sequence
  Description of Artificial Sequence: example target DNA
ggggcgtga

SEQ ID NO: 2360 - DNA, 9 bp, Artificial Sequence
  Description of Artificial Sequence: example target DNA
ggggcgtga

SEQ ID NO: 2361 - DNA, 9 bp, Artificial Sequence
  Description of Artificial Sequence: example target DNA
gtacagtag

SEQ ID NO: 2362 - DNA, 9 bp, Artificial Sequence
  Description of Artificial Sequence: example target DNA
gtacagtag

SEQ ID NO: 2363 - DNA, 9 bp, Artificial Sequence
  Description of Artificial Sequence: example target DNA
atggtgtgt

SEQ ID NO: 2364 - DNA, 9 bp, Artificial Sequence
  Description of Artificial Sequence: example target DNA
atggtgtgt

SEQ ID NO: 2365 - DNA, 9 bp, Artificial Sequence
  Description of Artificial Sequence: example target DNA
ttgggagag

SEQ ID NO: 2366 - DNA, 9 bp, Artificial Sequence
  Description of Artificial Sequence: example target DNA
ttgggagag

SEQ ID NO: 2367 - DNA, 9 bp, Artificial Sequence
  Description of Artificial Sequence: example target DNA
gtgggaata

SEQ ID NO: 2368 - DNA, 9 bp, Artificial Sequence
  Description of Artificial Sequence: example target DNA
gtgggaata

SEQ ID NO: 2369 - DNA, 9 bp, Artificial Sequence
  Description of Artificial Sequence: example target DNA
gtgggaata

SEQ ID NO: 2370 - DNA, 9 bp, Artificial Sequence
  Description of Artificial Sequence: example target DNA
ttggttggt

SEQ ID NO: 2371 - DNA, 9 bp, Artificial Sequence
  Description of Artificial Sequence: example target DNA
ttggttggt

SEQ ID NO: 2372 - DNA, 9 bp, Artificial Sequence
  Description of Artificial Sequence: example target DNA
ttggttggt

SEQ ID NO: 2373 - DNA, 9 bp, Artificial Sequence
  Description of Artificial Sequence: example target DNA
ttggttggt

SEQ ID NO: 2374 - DNA, 9 bp, Artificial Sequence
  Description of Artificial Sequence: example target DNA
ctggcctgg

SEQ ID NO: 2375 - DNA, 9 bp, Artificial Sequence
  Description of Artificial Sequence: example target DNA
gaggtgtga

SEQ ID NO: 2376 - DNA, 9 bp, Artificial Sequence
  Description of Artificial Sequence: example target DNA
ctggcctgg

SEQ ID NO: 2377 - DNA, 9 bp, Artificial Sequence
  Description of Artificial Sequence: example target DNA
ccggcgctg

SEQ ID NO: 2378 - DNA, 9 bp, Artificial Sequence
  Description of Artificial Sequence: example target DNA
gacgctggc

SEQ ID NO: 2379 - DNA, 9 bp, Artificial Sequence
  Description of Artificial Sequence: example target DNA
cgggctgga

SEQ ID NO: 2380 - DNA, 9 bp, Artificial Sequence
  Description of Artificial Sequence: example target DNA
cgggctgga

SEQ ID NO: 2381 - DNA, 9 bp, Artificial Sequence
  Description of Artificial Sequence: example target DNA
gggatggcg

SEQ ID NO: 2382 - DNA, 9 bp, Artificial Sequence
  Description of Artificial Sequence: example target DNA
gggatggcg

SEQ ID NO: 2383 - DNA, 9 bp, Artificial Sequence
  Description of Artificial Sequence: example target DNA
gggatggcg

SEQ ID NO: 2384 - DNA, 9 bp, Artificial Sequence
  Description of Artificial Sequence: example target DNA
gggatggcg

SEQ ID NO: 2385 - DNA, 9 bp, Artificial Sequence
  Description of Artificial Sequence: example target DNA
caggcgcag

SEQ ID NO: 2386 - DNA, 9 bp, Artificial Sequence
  Description of Artificial Sequence: example target DNA
caggcgcag

SEQ ID NO: 2387 - DNA, 9 bp, Artificial Sequence
  Description of Artificial Sequence: example target DNA
ccgggcgac

SEQ ID NO: 2388 - DNA, 9 bp, Artificial Sequence
  Description of Artificial Sequence: example target DNA
gatgtgtga

SEQ ID NO: 2389 - DNA, 9 bp, Artificial Sequence
  Description of Artificial Sequence: example target DNA
cagtgaatg

SEQ ID NO: 2390 - DNA, 9 bp, Artificial Sequence
  Description of Artificial Sequence: example target DNA
gggtcactg

SEQ ID NO: 2391 - DNA, 9 bp, Artificial Sequence
  Description of Artificial Sequence: example target DNA
cagtgaatg

SEQ ID NO: 2392 - DNA, 9 bp, Artificial Sequence
  Description of Artificial Sequence: example target DNA
gggtcactg

SEQ ID NO: 2393 - DNA, 9 bp, Artificial Sequence
  Description of Artificial Sequence: example target DNA
gtgtgggtc

SEQ ID NO: 2394 - DNA, 9 bp, Artificial Sequence
  Description of Artificial Sequence: example target DNA
ctggcgaga

SEQ ID NO: 2395 - DNA, 9 bp, Artificial Sequence
  Description of Artificial Sequence: example target DNA
ctggcgaga

SEQ ID NO: 2396 - DNA, 9 bp, Artificial Sequence
  Description of Artificial Sequence: example target DNA
gctttggca

SEQ ID NO: 2397 - DNA, 9 bp, Artificial Sequence
  Description of Artificial Sequence: example target DNA
gctttggca

SEQ ID NO: 2398 - DNA, 9 bp, Artificial Sequence
  Description of Artificial Sequence: example target DNA
gacttggta

SEQ ID NO: 2399 - DNA, 9 bp, Artificial Sequence
  Description of Artificial Sequence: example target DNA
gacttggta

SEQ ID NO: 2400 - DNA, 9 bp, Artificial Sequence
  Description of Artificial Sequence: example target DNA
cagttgtga

SEQ ID NO: 2401 - DNA, 9 bp, Artificial Sequence
  Description of Artificial Sequence: example target DNA
aaggaaaaa

SEQ ID NO: 2402 - DNA, 9 bp, Artificial Sequence
  Description of Artificial Sequence: example target DNA
aaggaaaaa

SEQ ID NO: 2403 - DNA, 9 bp, Artificial Sequence
  Description of Artificial Sequence: example target DNA
aaggaaaaa

SEQ ID NO: 2404 - DNA, 9 bp, Artificial Sequence
  Description of Artificial Sequence: example target DNA
atgggtgaa

SEQ ID NO: 2405 - DNA, 9 bp, Artificial Sequence
  Description of Artificial Sequence: example target DNA
atgggtgaa

SEQ ID NO: 2406 - DNA, 9 bp, Artificial Sequence
  Description of Artificial Sequence: example target DNA
atgggtgaa

SEQ ID NO: 2407 - DNA, 9 bp, Artificial Sequence
  Description of Artificial Sequence: example target DNA
atgggtgaa

SEQ ID NO: 2408 - DNA, 9 bp, Artificial Sequence
  Description of Artificial Sequence: example target DNA
ctgggagat

SEQ ID NO: 2409 - DNA, 9 bp, Artificial Sequence
  Description of Artificial Sequence: example target DNA
ctgggagat

SEQ ID NO: 2410 - DNA, 9 bp, Artificial Sequence
  Description of Artificial Sequence: example target DNA
gtggtgggc

SEQ ID NO: 2411 - DNA, 9 bp, Artificial Sequence
  Description of Artificial Sequence: example target DNA
ccggcggtg

SEQ ID NO: 2412 - DNA, 9 bp, Artificial Sequence
  Description of Artificial Sequence: example target DNA
ccggcggtg

SEQ ID NO: 2413 - DNA, 9 bp, Artificial Sequence
  Description of Artificial Sequence: example target DNA
ccggcggtg

SEQ ID NO: 2414 - DNA, 9 bp, Artificial Sequence
  Description of Artificial Sequence: example target DNA
ccggcggtg

SEQ ID NO: 2415 - DNA, 9 bp, Artificial Sequence
  Description of Artificial Sequence: example target DNA
ccggcggtg

SEQ ID NO: 2416 - DNA, 9 bp, Artificial Sequence
  Description of Artificial Sequence: example target DNA
ccggcggtg

SEQ ID NO: 2417 - DNA, 9 bp, Artificial Sequence
  Description of Artificial Sequence: example target DNA
gccgacggt

SEQ ID NO: 2418 - DNA, 9 bp, Artificial Sequence
  Description of Artificial Sequence: example target DNA
gccgacggt

SEQ ID NO: 2419 - DNA, 9 bp, Artificial Sequence
  Description of Artificial Sequence: example target DNA
gccgacggt

SEQ ID NO: 2420 - DNA, 9 bp, Artificial Sequence
  Description of Artificial Sequence: example target DNA
gccgacggt

SEQ ID NO: 2421 - DNA, 9 bp, Artificial Sequence
  Description of Artificial Sequence: example target DNA
ggtgtgggc

SEQ ID NO: 2422 - DNA, 9 bp, Artificial Sequence
  Description of Artificial Sequence: example target DNA
tgggcaaga

SEQ ID NO: 2423 - DNA, 9 bp, Artificial Sequence
  Description of Artificial Sequence: example target DNA
tgggcaaga

SEQ ID NO: 2424 - DNA, 9 bp, Artificial Sequence
  Description of Artificial Sequence: example target DNA
ctggcctgg

SEQ ID NO: 2425 - DNA, 9 bp, Artificial Sequence
  Description of Artificial Sequence: example target DNA
tgggaagct

SEQ ID NO: 2426 - DNA, 9 bp, Artificial Sequence
  Description of Artificial Sequence: example target DNA
tgggaagct

SEQ ID NO: 2427 - DNA, 9 bp, Artificial Sequence
  Description of Artificial Sequence: example target DNA
gaagaggga

SEQ ID NO: 2428 - DNA, 9 bp, Artificial Sequence
  Description of Artificial Sequence: example target DNA
gaagaggga

SEQ ID NO: 2429 - DNA, 9 bp, Artificial Sequence
  Description of Artificial Sequence: example target DNA
gaagaggga

SEQ ID NO: 2430 - DNA, 9 bp, Artificial Sequence
  Description of Artificial Sequence: example target DNA
taatggggg

SEQ ID NO: 2431 - DNA, 9 bp, Artificial Sequence
  Description of Artificial Sequence: example target DNA
tgggagtgt

SEQ ID NO: 2432 - DNA, 9 bp, Artificial Sequence
  Description of Artificial Sequence: example target DNA
ccgggtgag

SEQ ID NO: 2433 - DNA, 9 bp, Artificial Sequence
  Description of Artificial Sequence: example target DNA
gagttggcc

SEQ ID NO: 2434 - DNA, 9 bp, Artificial Sequence
  Description of Artificial Sequence: example target DNA
ctggagttg

SEQ ID NO: 2435 - DNA, 9 bp, Artificial Sequence
  Description of Artificial Sequence: example target DNA
atggcaatg

SEQ ID NO: 2436 - DNA, 9 bp, Artificial Sequence
  Description of Artificial Sequence: example target DNA
gaggcaggg

SEQ ID NO: 2437 - DNA, 9 bp, Artificial Sequence
  Description of Artificial Sequence: example target DNA
gaggcaggg

SEQ ID NO: 2438 - DNA, 9 bp, Artificial Sequence
  Description of Artificial Sequence: example target DNA
gaagcggag

SEQ ID NO: 2439 - DNA, 9 bp, Artificial Sequence
  Description of Artificial Sequence: example target DNA
gcgggcgca

SEQ ID NO: 2440 - DNA, 9 bp, Artificial Sequence
  Description of Artificial Sequence: example target DNA
ccggcaggg

SEQ ID NO: 2441 - DNA, 9 bp, Artificial Sequence
  Description of Artificial Sequence: example target DNA
ccggcaggg

SEQ ID NO: 2442 - DNA, 9 bp, Artificial Sequence
  Description of Artificial Sequence: example target DNA
ccggcggcg

SEQ ID NO: 2443 - DNA, 9 bp, Artificial Sequence
  Description of Artificial Sequence: example target DNA
tgaggcgag

SEQ ID NO: 2444 - DNA, 9 bp, Artificial Sequence
  Description of Artificial Sequence: example target DNA
ctggccgtg

SEQ ID NO: 2445 - DNA, 9 bp, Artificial Sequence
  Description of Artificial Sequence: example target DNA
ctggccgcg

SEQ ID NO: 2446 - DNA, 9 bp, Artificial Sequence
  Description of Artificial Sequence: example target DNA
ctggccgcg

SEQ ID NO: 2447 - DNA, 9 bp, Artificial Sequence
  Description of Artificial Sequence: example target DNA
gcggccgag

SEQ ID NO: 2448 - DNA, 9 bp, Artificial Sequence
  Description of Artificial Sequence: example target DNA
gcggccgag

SEQ ID NO: 2449 - DNA, 9 bp, Artificial Sequence
  Description of Artificial Sequence: example target DNA
gagttggcc

SEQ ID NO: 2450 - DNA, 9 bp, Artificial Sequence
  Description of Artificial Sequence: example target DNA
ctggagttg

SEQ ID NO: 2451 - DNA, 9 bp, Artificial Sequence
  Description of Artificial Sequence: example target DNA
gggtcggcg

SEQ ID NO: 2452 - DNA, 9 bp, Artificial Sequence
  Description of Artificial Sequence: example target DNA
gggtcggcg

SEQ ID NO: 2453 - DNA, 9 bp, Artificial Sequence
  Description of Artificial Sequence: example target DNA
cagggcccg

SEQ ID NO: 2454 - DNA, 9 bp, Artificial Sequence
  Description of Artificial Sequence: example target DNA
cagggcccg

SEQ ID NO: 2455 - DNA, 9 bp, Artificial Sequence
  Description of Artificial Sequence: example target DNA
tgaggcgag

SEQ ID NO: 2456 - DNA, 9 bp, Artificial Sequence
  Description of Artificial Sequence: example target DNA
tgaggcgag

SEQ ID NO: 2457 - DNA, 9 bp, Artificial Sequence
  Description of Artificial Sequence: example target DNA
tcggccgcc

SEQ ID NO: 2458 - DNA, 9 bp, Artificial Sequence
  Description of Artificial Sequence: example target DNA
tcggccgcc

SEQ ID NO: 2459 - DNA, 9 bp, Artificial Sequence
  Description of Artificial Sequence: example target DNA
tcggccgcc

SEQ ID NO: 2460 - DNA, 9 bp, Artificial Sequence
  Description of Artificial Sequence: example target DNA
ctggccgtg

SEQ ID NO: 2461 - DNA, 9 bp, Artificial Sequence
  Description of Artificial Sequence: example target DNA
taatggggg

SEQ ID NO: 2462 - DNA, 9 bp, Artificial Sequence
  Description of Artificial Sequence: example target DNA
tgggagtgt

SEQ ID NO: 2463 - DNA, 9 bp, Artificial Sequence
  Description of Artificial Sequence: example target DNA
ggagtgtta

SEQ ID NO: 2464 - DNA, 9 bp, Artificial Sequence
  Description of Artificial Sequence: example target DNA
ggagtgtta

SEQ ID NO: 2465 - DNA, 9 bp, Artificial Sequence
  Description of Artificial Sequence: example target DNA
atagctggg

SEQ ID NO: 2466 - DNA, 9 bp, Artificial Sequence
  Description of Artificial Sequence: example target DNA
tgctgggcc

SEQ ID NO: 2467 - DNA, 9 bp, Artificial Sequence
  Description of Artificial Sequence: example target DNA
tggaaggaa

SEQ ID NO: 2468 - DNA, 9 bp, Artificial Sequence
  Description of Artificial Sequence: example target DNA
tggaaggaa

SEQ ID NO: 2469 - DNA, 9 bp, Artificial Sequence
  Description of Artificial Sequence: example target DNA
tggaaggaa

SEQ ID NO: 2470 - DNA, 9 bp, Artificial Sequence
  Description of Artificial Sequence: example target DNA
tggaaggaa

SEQ ID NO: 2471 - DNA, 9 bp, Artificial Sequence
  Description of Artificial Sequence: example target DNA
ggagaggct

SEQ ID NO: 2472 - DNA, 9 bp, Artificial Sequence
  Description of Artificial Sequence: example target DNA
cgggatgaa

SEQ ID NO: 2473 - DNA, 9 bp, Artificial Sequence
  Description of Artificial Sequence: example target DNA
ggagaggct

SEQ ID NO: 2474 - DNA, 9 bp, Artificial Sequence
  Description of Artificial Sequence: example target DNA
gcagaggaa

SEQ ID NO: 2475 - DNA, 9 bp, Artificial Sequence
  Description of Artificial Sequence: example target DNA
ttgggggag

SEQ ID NO: 2476 - DNA, 9 bp, Artificial Sequence
  Description of Artificial Sequence: example target DNA
gacgaggag

SEQ ID NO: 2477 - DNA, 9 bp, Artificial Sequence
  Description of Artificial Sequence: example target DNA
cgggatgaa

SEQ ID NO: 2478 - DNA, 9 bp, Artificial Sequence
  Description of Artificial Sequence: example target DNA
gaggctgtt

SEQ ID NO: 2479 - DNA, 9 bp, Artificial Sequence
  Description of Artificial Sequence: example target DNA
gacgaggag

SEQ ID NO: 2480 - DNA, 9 bp, Artificial Sequence
  Description of Artificial Sequence: example target DNA
ctgggagtt

SEQ ID NO: 2481 - DNA, 9 bp, Artificial Sequence
  Description of Artificial Sequence: example target DNA
ctgggagtt

SEQ ID NO: 2482 - DNA, 9 bp, Artificial Sequence
  Description of Artificial Sequence: example target DNA
ggtgatgtc

SEQ ID NO: 2483 - DNA, 9 bp, Artificial Sequence
  Description of Artificial Sequence: example target DNA
ggtgatgtc

SEQ ID NO: 2484 - DNA, 9 bp, Artificial Sequence
  Description of Artificial Sequence: example target DNA
ggtgatgtc

SEQ ID NO: 2485 - DNA, 9 bp, Artificial Sequence
  Description of Artificial Sequence: example target DNA
ctggttggg

SEQ ID NO: 2486 - DNA, 9 bp, Artificial Sequence
  Description of Artificial Sequence: example target DNA
ttgaaggtt

SEQ ID NO: 2487 - DNA, 9 bp, Artificial Sequence
  Description of Artificial Sequence: example target DNA
ttgaaggtt

SEQ ID NO: 2488 - DNA, 9 bp, Artificial Sequence
  Description of Artificial Sequence: example target DNA
ttgaaggtt

SEQ ID NO: 2489 - DNA, 9 bp, Artificial Sequence
  Description of Artificial Sequence: example target DNA
ttgaaggtt

SEQ ID NO: 2490 - DNA, 9 bp, Artificial Sequence
  Description of Artificial Sequence: example target DNA
ttgaaggtt

SEQ ID NO: 2491 - DNA, 9 bp, Artificial Sequence
  Description of Artificial Sequence: example target DNA
gcagcccgg

SEQ ID NO: 2492 - DNA, 9 bp, Artificial Sequence
  Description of Artificial Sequence: example target DNA
gaaagttca

SEQ ID NO: 2493 - DNA, 9 bp, Artificial Sequence
  Description of Artificial Sequence: example target DNA
gaaagttca

SEQ ID NO: 2494 - DNA, 9 bp, Artificial Sequence
  Description of Artificial Sequence: example target DNA
gaaagttca

SEQ ID NO: 2495 - DNA, 9 bp, Artificial Sequence
  Description of Artificial Sequence: example target DNA
ccgtgtgac

SEQ ID NO: 2496 - DNA, 9 bp, Artificial Sequence
  Description of Artificial Sequence: example target DNA
ccgtgtgac

SEQ ID NO: 2497 - DNA, 9 bp, Artificial Sequence
  Description of Artificial Sequence: example target DNA
gaagtggta

SEQ ID NO: 2498 - DNA, 9 bp, Artificial Sequence
  Description of Artificial Sequence: example target DNA
aagtgagct

SEQ ID NO: 2499 - DNA, 9 bp, Artificial Sequence
  Description of Artificial Sequence: example target DNA
gggtttgac

SEQ ID NO: 2500 - DNA, 9 bp, Artificial Sequence
  Description of Artificial Sequence: example target DNA
ttgaaggtt

SEQ ID NO: 2501 - DNA, 9 bp, Artificial Sequence
  Description of Artificial Sequence: example target DNA
aagtggtag

SEQ ID NO: 2502 - DNA, 9 bp, Artificial Sequence
  Description of Artificial Sequence: example target DNA
ctggttggg

SEQ ID NO: 2503 - DNA, 9 bp, Artificial Sequence
  Description of Artificial Sequence: example target DNA
aagggttca

SEQ ID NO: 2504 - DNA, 9 bp, Artificial Sequence
  Description of Artificial Sequence: example target DNA
aagtggtag

SEQ ID NO: 2505 - DNA, 9 bp, Artificial Sequence
  Description of Artificial Sequence: example target DNA
aagtggtag

SEQ ID NO: 2506 - DNA, 9 bp, Artificial Sequence
  Description of Artificial Sequence: example target DNA
gggtttgac

SEQ ID NO: 2507 - DNA, 9 bp, Artificial Sequence
  Description of Artificial Sequence: example target DNA
ttgggggag

SEQ ID NO: 2508 - DNA, 9 bp, Artificial Sequence
  Description of Artificial Sequence: example target DNA
gaggctctt

SEQ ID NO: 2509 - DNA, 9 bp, Artificial Sequence
  Description of Artificial Sequence: example target DNA
gaggttgat

SEQ ID NO: 2510 - DNA, 9 bp, Artificial Sequence
  Description of Artificial Sequence: example target DNA
gaggttgat

SEQ ID NO: 2511 - DNA, 9 bp, Artificial Sequence
  Description of Artificial Sequence: example target DNA
gcagaggaa

SEQ ID NO: 2512 - DNA, 9 bp, Artificial Sequence
  Description of Artificial Sequence: example target DNA
gcaatgggt

SEQ ID NO: 2513 - protein, 7 aa, Artificial Sequence
  Description of Artificial Sequence: example ZFP
RSDHLAR

SEQ ID NO: 2514 - protein, 7 aa, Artificial Sequence
  Description of Artificial Sequence: example ZFP
DSSNLTR

SEQ ID NO: 2515 - protein, 7 aa, Artificial Sequence
  Description of Artificial Sequence: example ZFP
RSSALTR

SEQ ID NO: 2516 - protein, 7 aa, Artificial Sequence
  Description of Artificial Sequence: example ZFP
QSGDLRT

SEQ ID NO: 2517 - protein, 7 aa, Artificial Sequence
  Description of Artificial Sequence: example ZFP
QSGNLSR

SEQ ID NO: 2518 - protein, 7 aa, Artificial Sequence
  Description of Artificial Sequence: example ZFP
QSSNLAR

SEQ ID NO: 2519 - protein, 7 aa, Artificial Sequence
  Description of Artificial Sequence: example ZFP
QSGSLTR

SEQ ID NO: 2520 - protein, 7 aa, Artificial Sequence
  Description of Artificial Sequence: example ZFP
RSDSLAR

SEQ ID NO: 2521 - protein, 7 aa, Artificial Sequence
  Description of Artificial Sequence: example ZFP
RSDNLTQ

SEQ ID NO: 2522 - protein, 7 aa, Artificial Sequence
  Description of Artificial Sequence: example ZFP
RSDNLRQ

SEQ ID NO: 2523 - protein, 7 aa, Artificial Sequence
  Description of Artificial Sequence: example ZFP
QSGHLAR

SEQ ID NO: 2524 - protein, 7 aa, Artificial Sequence
  Description of Artificial Sequence: example ZFP
RSDNLTT

SEQ ID NO: 2525 - protein, 7 aa, Artificial Sequence
  Description of Artificial Sequence: example ZFP
QSSSLVR

SEQ ID NO: 2526 - protein, 7 aa, Artificial Sequence
  Description of Artificial Sequence: example ZFP
QSGDLRT

SEQ ID NO: 2527 - protein, 7 aa, Artificial Sequence
  Description of Artificial Sequence: example ZFP
QSHDLTK

SEQ ID NO: 2528 - protein, 7 aa, Artificial Sequence
  Description of Artificial Sequence: example ZFP
QSHDLTK

SEQ ID NO: 2529 - protein, 7 aa, Artificial Sequence
  Description of Artificial Sequence: example ZFP
RSDALTR

SEQ ID NO: 2530 - protein, 7 aa, Artificial Sequence
  Description of Artificial Sequence: example ZFP
RSDNLAR

SEQ ID NO: 2531 - protein, 7 aa, Artificial Sequence
  Description of Artificial Sequence: example ZFP
RSDNLAR

SEQ ID NO: 2532 - protein, 7 aa, Artificial Sequence
  Description of Artificial Sequence: example ZFP
QSSNLAR

SEQ ID NO: 2533 - protein, 7 aa, Artificial Sequence
  Description of Artificial Sequence: example ZFP
RSDNLAR

SEQ ID NO: 2534 - protein, 7 aa, Artificial Sequence
  Description of Artificial Sequence: example ZFP
RSDHLAR

SEQ ID NO: 2535 - protein, 7 aa, Artificial Sequence
  Description of Artificial Sequence: example ZFP
QSANLAR

SEQ ID NO: 2536 - protein, 7 aa, Artificial Sequence
  Description of Artificial Sequence: example ZFP
QSSNLAR

SEQ ID NO: 2537 - protein, 7 aa, Artificial Sequence
  Description of Artificial Sequence: example ZFP
QSGSLTR

SEQ ID NO: 2538 - protein, 7 aa, Artificial Sequence
  Description of Artificial Sequence: example ZFP
QSSDLTR

SEQ ID NO: 2539 - protein, 7 aa, Artificial Sequence
  Description of Artificial Sequence: example ZFP
QSSDLRR

SEQ ID NO: 2540 - protein, 7 aa, Artificial Sequence
  Description of Artificial Sequence: example ZFP
RSDHLTT

SEQ ID NO: 2541 - protein, 7 aa, Artificial Sequence
  Description of Artificial Sequence: example ZFP
RSDHLTK

SEQ ID NO: 2542 - protein, 7 aa, Artificial Sequence
  Description of Artificial Sequence: example ZFP
RSDHLAR

SEQ ID NO: 2543 - protein, 7 aa, Artificial Sequence
  Description of Artificial Sequence: example ZFP
RSDHLAR

SEQ ID NO: 2544 - protein, 7 aa, Artificial Sequence
  Description of Artificial Sequence: example ZFP
RSDHLAR

SEQ ID NO: 2545 - protein, 7 aa, Artificial Sequence
  Description of Artificial Sequence: example ZFP
RSDHLAR

SEQ ID NO: 2546 - protein, 7 aa, Artificial Sequence
  Description of Artificial Sequence: example ZFP
RSDSLTR

SEQ ID NO: 2547 - protein, 7 aa, Artificial Sequence
  Description of Artificial Sequence: example ZFP
RSDSLTR

SEQ ID NO: 2548 - protein, 7 aa, Artificial Sequence
  Description of Artificial Sequence: example ZFP
RSDSLTR

SEQ ID NO: 2549 - protein, 7 aa, Artificial Sequence
  Description of Artificial Sequence: example ZFP
RSDSLTR

SEQ ID NO: 2550 - protein, 7 aa, Artificial Sequence
  Description of Artificial Sequence: example ZFP
QSGSLTR

SEQ ID NO: 2551 - protein, 7 aa, Artificial Sequence
  Description of Artificial Sequence: example ZFP
QSGSLTR

SEQ ID NO: 2552 - protein, 7 aa, Artificial Sequence
  Description of Artificial Sequence: example ZFP
RSDALAR

SEQ ID NO: 2553 - protein, 7 aa, Artificial Sequence
  Description of Artificial Sequence: example ZFP
ERGDLTR

SEQ ID NO: 2554 - protein, 7 aa, Artificial Sequence
  Description of Artificial Sequence: example ZFP
ERGTLAR

SEQ ID NO: 2555 - protein, 7 aa, Artificial Sequence
  Description of Artificial Sequence: example ZFP
DRSSLTR

SEQ ID NO: 2556 - protein, 7 aa, Artificial Sequence
  Description of Artificial Sequence: example ZFP
QSGSLTR

SEQ ID NO: 2557 - protein, 7 aa, Artificial Sequence
  Description of Artificial Sequence: example ZFP
QSGSLTR

SEQ ID NO: 2558 - protein, 7 aa, Artificial Sequence
  Description of Artificial Sequence: example ZFP
ERGTLAR

SEQ ID NO: 2559 - protein, 7 aa, Artificial Sequence
  Description of Artificial Sequence: example ZFP
DRSSLTR

SEQ ID NO: 2560 - protein, 7 aa, Artificial Sequence
  Description of Artificial Sequence: example ZFP
ERGDLTR

SEQ ID NO: 2561 - protein, 7 aa, Artificial Sequence
  Description of Artificial Sequence: example ZFP
DRSALTR

SEQ ID NO: 2562 - protein, 7 aa, Artificial Sequence
  Description of Artificial Sequence: example ZFP
DRSALTR

SEQ ID NO: 2563 - protein, 7 aa, Artificial Sequence
  Description of Artificial Sequence: example ZFP
QSSDLTR

SEQ ID NO: 2564 - protein, 7 aa, Artificial Sequence
  Description of Artificial Sequence: example ZFP
QSSDLTR

SEQ ID NO: 2565 - protein, 7 aa, Artificial Sequence
  Description of Artificial Sequence: example ZFP
RSDSLTR

SEQ ID NO: 2566 - protein, 7 aa, Artificial Sequence
  Description of Artificial Sequence: example ZFP
RSDSLTR

SEQ ID NO: 2567 - protein, 7 aa, Artificial Sequence
  Description of Artificial Sequence: example ZFP
RSSDLTR

SEQ ID NO: 2568 - protein, 7 aa, Artificial Sequence
  Description of Artificial Sequence: example ZFP
RSDDLTR

SEQ ID NO: 2569 - protein, 7 aa, Artificial Sequence
  Description of Artificial Sequence: example ZFP
RSDDLTR

SEQ ID NO: 2570 - protein, 7 aa, Artificial Sequence
  Description of Artificial Sequence: example ZFP
RSDHLTT

SEQ ID NO: 2571 - protein, 7 aa, Artificial Sequence
  Description of Artificial Sequence: example ZFP
RSDHLTK

SEQ ID NO: 2572 - protein, 7 aa, Artificial Sequence
  Description of Artificial Sequence: example ZFP
RSDNLAR

SEQ ID NO: 2573 - protein, 7 aa, Artificial Sequence
  Description of Artificial Sequence: example ZFP
RSDNLAR

SEQ ID NO: 2574 - protein, 7 aa, Artificial Sequence
  Description of Artificial Sequence: example ZFP
QSSNLQR

SEQ ID NO: 2575 - protein, 7 aa, Artificial Sequence
  Description of Artificial Sequence: example ZFP
QSSNLQR

SEQ ID NO: 2576 - protein, 7 aa, Artificial Sequence
  Description of Artificial Sequence: example ZFP
TSGNLVR

SEQ ID NO: 2577 - protein, 7 aa, Artificial Sequence
  Description of Artificial Sequence: example ZFP
RSDHLAR

SEQ ID NO: 2578 - protein, 7 aa, Artificial Sequence
  Description of Artificial Sequence: example ZFP
DRSHLTR

SEQ ID NO: 2579 - protein, 7 aa, Artificial Sequence
  Description of Artificial Sequence: example ZFP
DRSHLTR

SEQ ID NO: 2580 - protein, 7 aa, Artificial Sequence
  Description of Artificial Sequence: example ZFP
RSDHLAR

SEQ ID NO: 2581 - protein, 7 aa, Artificial Sequence
  Description of Artificial Sequence: example ZFP
RSDHLTK

SEQ ID NO: 2582 - protein, 7 aa, Artificial Sequence
  Description of Artificial Sequence: example ZFP
QSANLAR

SEQ ID NO: 2583 - protein, 7 aa, Artificial Sequence
  Description of Artificial Sequence: example ZFP
DRSALAR

SEQ ID NO: 2584 - protein, 7 aa, Artificial Sequence
  Description of Artificial Sequence: example ZFP
QSSDLTR

SEQ ID NO: 2585 - protein, 7 aa, Artificial Sequence
  Description of Artificial Sequence: example ZFP
RSANLRT

SEQ ID NO: 2586 - protein, 7 aa, Artificial Sequence
  Description of Artificial Sequence: example ZFP
QSSDLTR

SEQ ID NO: 2587 - protein, 7 aa, Artificial Sequence
  Description of Artificial Sequence: example ZFP
DRSALAR

SEQ ID NO: 2588 - protein, 7 aa, Artificial Sequence
  Description of Artificial Sequence: example ZFP
EKANLTR

SEQ ID NO: 2589 - protein, 7 aa, Artificial Sequence
  Description of Artificial Sequence: example ZFP
RSDNLVR

SEQ ID NO: 2590 - protein, 7 aa, Artificial Sequence
  Description of Artificial Sequence: example ZFP
RSANLRT

SEQ ID NO: 2591 - protein, 7 aa, Artificial Sequence
  Description of Artificial Sequence: example ZFP
RSDNLTT

SEQ ID NO: 2592 - protein, 7 aa, Artificial Sequence
  Description of Artificial Sequence: example ZFP
RSDDLTR

SEQ ID NO: 2593 - protein, 7 aa, Artificial Sequence
  Description of Artificial Sequence: example ZFP
QSSNLQR

SEQ ID NO: 2594 - protein, 7 aa, Artificial Sequence
  Description of Artificial Sequence: example ZFP
RSDNLSR

SEQ ID NO: 2595 - protein, 7 aa, Artificial Sequence
  Description of Artificial Sequence: example ZFP
RSDNLSR

SEQ ID NO: 2596 - protein, 7 aa, Artificial Sequence
  Description of Artificial Sequence: example ZFP
QSSNLQR

SEQ ID NO: 2597 - protein, 7 aa, Artificial Sequence
  Description of Artificial Sequence: example ZFP
RSADLTR

SEQ ID NO: 2598 - protein, 7 aa, Artificial Sequence
  Description of Artificial Sequence: example ZFP
RSDHLTR

SEQ ID NO: 2599 - protein, 7 aa, Artificial Sequence
  Description of Artificial Sequence: example ZFP
QSSNLQR

SEQ ID NO: 2600 - protein, 7 aa, Artificial Sequence
  Description of Artificial Sequence: example ZFP
RSDHLTR

SEQ ID NO: 2601 - protein, 7 aa, Artificial Sequence
  Description of Artificial Sequence: example ZFP
RSDNLVR

SEQ ID NO: 2602 - protein, 7 aa, Artificial Sequence
  Description of Artificial Sequence: example ZFP
DRSALAR

SEQ ID NO: 2603 - protein, 7 aa, Artificial Sequence
  Description of Artificial Sequence: example ZFP
EKANLTR

SEQ ID NO: 2604 - protein, 7 aa, Artificial Sequence
  Description of Artificial Sequence: example ZFP
QSANLAR

SEQ ID NO: 2605 - protein, 7 aa, Artificial Sequence
  Description of Artificial Sequence: example ZFP
RSDNLAR

SEQ ID NO: 2606 - protein, 7 aa, Artificial Sequence
  Description of Artificial Sequence: example ZFP
RSDNLTT

SEQ ID NO: 2607 - protein, 7 aa, Artificial Sequence
  Description of Artificial Sequence: example ZFP
RSDALAR

SEQ ID NO: 2608 - protein, 7 aa, Artificial Sequence
  Description of Artificial Sequence: example ZFP
QSANLAR

SEQ ID NO: 2609 - protein, 7 aa, Artificial Sequence
  Description of Artificial Sequence: example ZFP
QSSALTR

SEQ ID NO: 2610 - protein, 7 aa, Artificial Sequence
  Description of Artificial Sequence: example ZFP
MSHHLKE

SEQ ID NO: 2611 - protein, 7 aa, Artificial Sequence
  Description of Artificial Sequence: example ZFP
RSDALAR

SEQ ID NO: 2612 - protein, 7 aa, Artificial Sequence
  Description of Artificial Sequence: example ZFP
TSGNLVR

SEQ ID NO: 2613 - protein, 7 aa, Artificial Sequence
  Description of Artificial Sequence: example ZFP
RSDALAR

SEQ ID NO: 2614 - protein, 7 aa, Artificial Sequence
  Description of Artificial Sequence: example ZFP
RSDALAR

SEQ ID NO: 2615 - protein, 7 aa, Artificial Sequence
  Description of Artificial Sequence: example ZFP
RSDALAR

SEQ ID NO: 2616 - protein, 7 aa, Artificial Sequence
  Description of Artificial Sequence: example ZFP
QSGSLTR

SEQ ID NO: 2617 - protein, 7 aa, Artificial Sequence
  Description of Artificial Sequence: example ZFP
QTGELRR

SEQ ID NO: 2618 - protein, 7 aa, Artificial Sequence
  Description of Artificial Sequence: example ZFP
RSDHLSR

SEQ ID NO: 2619 - protein, 7 aa, Artificial Sequence
  Description of Artificial Sequence: example ZFP
RSDHLSR

SEQ ID NO: 2620 - protein, 7 aa, Artificial Sequence
  Description of Artificial Sequence: example ZFP
RSDNLTT

SEQ ID NO: 2621 - protein, 7 aa, Artificial Sequence
  Description of Artificial Sequence: example ZFP
RSDNLAR

SEQ ID NO: 2622 - protein, 7 aa, Artificial Sequence
  Description of Artificial Sequence: example ZFP
RSDNLAR

SEQ ID NO: 2623 - protein, 7 aa, Artificial Sequence
  Description of Artificial Sequence: example ZFP
QSGHLAR

SEQ ID NO: 2624 - protein, 7 aa, Artificial Sequence
  Description of Artificial Sequence: example ZFP
QSGHLAR

SEQ ID NO: 2625 - protein, 7 aa, Artificial Sequence
  Description of Artificial Sequence: example ZFP
QRAHLER

SEQ ID NO: 2626 - protein, 7 aa, Artificial Sequence
  Description of Artificial Sequence: example ZFP
QSGALTR

SEQ ID NO: 2627 - protein, 7 aa, Artificial Sequence
  Description of Artificial Sequence: example ZFP
QRASLAR

SEQ ID NO: 2628 - protein, 7 aa, Artificial Sequence
  Description of Artificial Sequence: example ZFP
QSSSLVR

SEQ ID NO: 2629 - protein, 7 aa, Artificial Sequence
  Description of Artificial Sequence: example ZFP
RSDNLTR

SEQ ID NO: 2630 - protein, 7 aa, Artificial Sequence
  Description of Artificial Sequence: example ZFP
RSDHLAR

SEQ ID NO: 2631 - protein, 7 aa, Artificial Sequence
  Description of Artificial Sequence: example ZFP
RSDHLAR

SEQ ID NO: 2632 - protein, 7 aa, Artificial Sequence
  Description of Artificial Sequence: example ZFP
RSDHLAR

SEQ ID NO: 2633 - protein, 7 aa, Artificial Sequence
  Description of Artificial Sequence: example ZFP
RSDHLAR

SEQ ID NO: 2634 - protein, 7 aa, Artificial Sequence
  Description of Artificial Sequence: example ZFP
RSDHLAR

SEQ ID NO: 2635 - protein, 7 aa, Artificial Sequence
  Description of Artificial Sequence: example ZFP
RSDHLAR

SEQ ID NO: 2636 - protein, 7 aa, Artificial Sequence
  Description of Artificial Sequence: example ZFP
RSDELTR

SEQ ID NO: 2637 - protein, 7 aa, Artificial Sequence
  Description of Artificial Sequence: example ZFP
RSDELTR

SEQ ID NO: 2638 - protein, 7 aa, Artificial Sequence
  Description of Artificial Sequence: example ZFP
ERGTLAR

SEQ ID NO: 2639 - protein, 7 aa, Artificial Sequence
  Description of Artificial Sequence: example ZFP
RSDHLAR

SEQ ID NO: 2640 - protein, 7 aa, Artificial Sequence
  Description of Artificial Sequence: example ZFP
RSDHLAR

SEQ ID NO: 2641 - protein, 7 aa, Artificial Sequence
  Description of Artificial Sequence: example ZFP
RSDHLAR

SEQ ID NO: 2642 - protein, 7 aa, Artificial Sequence
  Description of Artificial Sequence: example ZFP
RSDALTR

SEQ ID NO: 2643 - protein, 7 aa, Artificial Sequence
  Description of Artificial Sequence: example ZFP
RSDHLAR

SEQ ID NO: 2644 - protein, 7 aa, Artificial Sequence
  Description of Artificial Sequence: example ZFP
QSSHLTR

SEQ ID NO: 2645 - protein, 7 aa, Artificial Sequence
  Description of Artificial Sequence: example ZFP
TSGHLVR

SEQ ID NO: 2646 - protein, 7 aa, Artificial Sequence
  Description of Artificial Sequence: example ZFP
DRSHLTR

SEQ ID NO: 2647 - protein, 7 aa, Artificial Sequence
  Description of Artificial Sequence: example ZFP
DRSHLTR

SEQ ID NO: 2648 - protein, 7 aa, Artificial Sequence
  Description of Artificial Sequence: example ZFP
DRSHLTR

SEQ ID NO: 2649 - protein, 7 aa, Artificial Sequence
  Description of Artificial Sequence: example ZFP
DRSHLTR

SEQ ID NO: 2650 - protein, 7 aa, Artificial Sequence
  Description of Artificial Sequence: example ZFP
QSSDLTR

SEQ ID NO: 2651 - protein, 7 aa, Artificial Sequence
  Description of Artificial Sequence: example ZFP
QSSDLTR

SEQ ID NO: 2652 - protein, 7 aa, Artificial Sequence
  Description of Artificial Sequence: example ZFP
RSDELTR

SEQ ID NO: 2653 - protein, 7 aa, Artificial Sequence
  Description of Artificial Sequence: example ZFP
RSDELTR

SEQ ID NO: 2654 - protein, 7 aa, Artificial Sequence
  Description of Artificial Sequence: example ZFP
RSDELTR

SEQ ID NO: 2655 - protein, 7 aa, Artificial Sequence
  Description of Artificial Sequence: example ZFP
ERGTLAR

SEQ ID NO: 2656 - protein, 7 aa, Artificial Sequence
  Description of Artificial Sequence: example ZFP
ERGDLTR

SEQ ID NO: 2657 - protein, 7 aa, Artificial Sequence
  Description of Artificial Sequence: example ZFP
RSDELTR

SEQ ID NO: 2658 - protein, 7 aa, Artificial Sequence
  Description of Artificial Sequence: example ZFP
RSDALTR

SEQ ID NO: 2659 - protein, 7 aa, Artificial Sequence
  Description of Artificial Sequence: example ZFP
RSDELTR

SEQ ID NO: 2660 - protein, 7 aa, Artificial Sequence
  Description of Artificial Sequence: example ZFP
QSGDLTR

SEQ ID NO: 2661 - protein, 7 aa, Artificial Sequence
  Description of Artificial Sequence: example ZFP
RSDELTR

SEQ ID NO: 2662 - protein, 7 aa, Artificial Sequence
  Description of Artificial Sequence: example ZFP
RSDELTR

SEQ ID NO: 2663 - protein, 7 aa, Artificial Sequence
  Description of Artificial Sequence: example ZFP
RSDHLSR

SEQ ID NO: 2664 - protein, 7 aa, Artificial Sequence
  Description of Artificial Sequence: example ZFP
ERGDLTR

SEQ ID NO: 2665 - protein, 7 aa, Artificial Sequence
  Description of Artificial Sequence: example ZFP
ERGDLTR

SEQ ID NO: 2666 - protein, 7 aa, Artificial Sequence
  Description of Artificial Sequence: example ZFP
QSSDLRR

SEQ ID NO: 2667 - protein, 7 aa, Artificial Sequence
  Description of Artificial Sequence: example ZFP
RSDALRE

SEQ ID NO: 2668 - protein, 7 aa, Artificial Sequence
  Description of Artificial Sequence: example ZFP
DRSNLTR

SEQ ID NO: 2669 - protein, 7 aa, Artificial Sequence
  Description of Artificial Sequence: example ZFP
QSSDLRR

SEQ ID NO: 2670 - protein, 7 aa, Artificial Sequence
  Description of Artificial Sequence: example ZFP
RSADLRT

SEQ ID NO: 2671 - protein, 7 aa, Artificial Sequence
  Description of Artificial Sequence: example ZFP
TSGHLVR

SEQ ID NO: 2672 - protein, 7 aa, Artificial Sequence
  Description of Artificial Sequence: example ZFP
ERGDLTR

SEQ ID NO: 2673 - protein, 7 aa, Artificial Sequence
  Description of Artificial Sequence: example ZFP
DRSSLTR

SEQ ID NO: 2674 - protein, 7 aa, Artificial Sequence
  Description of Artificial Sequence: example ZFP
QSANLAR

SEQ ID NO: 2675 - protein, 7 aa, Artificial Sequence
  Description of Artificial Sequence: example ZFP
RSDNLTR

SEQ ID NO: 2676 - protein, 7 aa, Artificial Sequence
  Description of Artificial Sequence: example ZFP
TSGHLVR

SEQ ID NO: 2677 - protein, 7 aa, Artificial Sequence
  Description of Artificial Sequence: example ZFP
QSGALTR

SEQ ID NO: 2678 - protein, 7 aa, Artificial Sequence
  Description of Artificial Sequence: example ZFP
TTSALTR

SEQ ID NO: 2679 - protein, 7 aa, Artificial Sequence
  Description of Artificial Sequence: example ZFP
QSANLAR

SEQ ID NO: 2680 - protein, 7 aa, Artificial Sequence
  Description of Artificial Sequence: example ZFP
QSANLAR

SEQ ID NO: 2681 - protein, 7 aa, Artificial Sequence
  Description of Artificial Sequence: example ZFP
QSSDLRR

SEQ ID NO: 2682 - protein, 7 aa, Artificial Sequence
  Description of Artificial Sequence: example ZFP
ERGDLTR

SEQ ID NO: 2683 - protein, 7 aa, Artificial Sequence
  Description of Artificial Sequence: example ZFP
DRSSLTR

SEQ ID NO: 2684 - protein, 7 aa, Artificial Sequence
  Description of Artificial Sequence: example ZFP
QSSALAR

SEQ ID NO: 2685 - protein, 7 aa, Artificial Sequence
  Description of Artificial Sequence: example ZFP
QSGHLAR

SEQ ID NO: 2686 - protein, 7 aa, Artificial Sequence
  Description of Artificial Sequence: example ZFP
ERGDLTR

SEQ ID NO: 2687 - protein, 7 aa, Artificial Sequence
  Description of Artificial Sequence: example ZFP
DRSSLTR

SEQ ID NO: 2688 - protein, 7 aa, Artificial Sequence
  Description of Artificial Sequence: example ZFP
RSDHLAR

SEQ ID NO: 2689 - protein, 7 aa, Artificial Sequence
  Description of Artificial Sequence: example ZFP
RSDHLAR

SEQ ID NO: 2690 - protein, 7 aa, Artificial Sequence
  Description of Artificial Sequence: example ZFP
QSGDLTR

SEQ ID NO: 2691 - protein, 7 aa, Artificial Sequence
  Description of Artificial Sequence: example ZFP
QSSNLAR

SEQ ID NO: 2692 - protein, 7 aa, Artificial Sequence
  Description of Artificial Sequence: example ZFP
QSSNLAR

SEQ ID NO: 2693 - protein, 7 aa, Artificial Sequence
  Description of Artificial Sequence: example ZFP
RSDELTR

SEQ ID NO: 2694 - protein, 7 aa, Artificial Sequence
  Description of Artificial Sequence: example ZFP
RSSNLRE

SEQ ID NO: 2695 - protein, 7 aa, Artificial Sequence
  Description of Artificial Sequence: example ZFP
DRSALTR

SEQ ID NO: 2696 - protein, 7 aa, Artificial Sequence
  Description of Artificial Sequence: example ZFP
TSGHLVR

SEQ ID NO: 2697 - protein, 7 aa, Artificial Sequence
  Description of Artificial Sequence: example ZFP
RSDELTR

SEQ ID NO: 2698 - protein, 7 aa, Artificial Sequence
  Description of Artificial Sequence: example ZFP
ERGDLTR

SEQ ID NO: 2699 - protein, 7 aa, Artificial Sequence
  Description of Artificial Sequence: example ZFP
DRSSLTR

SEQ ID NO: 2700 - protein, 7 aa, Artificial Sequence
  Description of Artificial Sequence: example ZFP
QSGSLTR

SEQ ID NO: 2701 - protein, 7 aa, Artificial Sequence
  Description of Artificial Sequence: example ZFP
QSGHLAR

SEQ ID NO: 2702 - protein, 7 aa, Artificial Sequence
  Description of Artificial Sequence: example ZFP
RSDALTS

SEQ ID NO: 2703 - protein, 7 aa, Artificial Sequence
  Description of Artificial Sequence: example ZFP
QSSALAR

SEQ ID NO: 2704 - protein, 7 aa, Artificial Sequence
  Description of Artificial Sequence: example ZFP
ERGDLTR

SEQ ID NO: 2705 - protein, 7 aa, Artificial Sequence
  Description of Artificial Sequence: example ZFP
DRSNLTR

SEQ ID NO: 2706 - protein, 7 aa, Artificial Sequence
  Description of Artificial Sequence: example ZFP
ERGDLTR

SEQ ID NO: 2707 - protein, 7 aa, Artificial Sequence
  Description of Artificial Sequence: example ZFP
QSGHLAR

SEQ ID NO: 2708 - protein, 7 aa, Artificial Sequence
  Description of Artificial Sequence: example ZFP
QRAHLER

SEQ ID NO: 2709 - protein, 7 aa, Artificial Sequence
  Description of Artificial Sequence: example ZFP
RSDHLTT

SEQ ID NO: 2710 - protein, 7 aa, Artificial Sequence
  Description of Artificial Sequence: example ZFP
RSDHLAR

SEQ ID NO: 2711 - protein, 7 aa, Artificial Sequence
  Description of Artificial Sequence: example ZFP
RSDALTR

SEQ ID NO: 2712 - protein, 7 aa, Artificial Sequence
  Description of Artificial Sequence: example ZFP
RSSALTR

SEQ ID NO: 2713 - protein, 7 aa, Artificial Sequence
  Description of Artificial Sequence: example ZFP
QSGALTR

SEQ ID NO: 2714 - protein, 7 aa, Artificial Sequence
  Description of Artificial Sequence: example ZFP
RSDNLAR

SEQ ID NO: 2715 - protein, 7 aa, Artificial Sequence
  Description of Artificial Sequence: example ZFP
RSDELTR

SEQ ID NO: 2716 - protein, 7 aa, Artificial Sequence
  Description of Artificial Sequence: example ZFP
RGDALTS

SEQ ID NO: 2717 - protein, 7 aa, Artificial Sequence
  Description of Artificial Sequence: example ZFP
RSDNLTR

SEQ ID NO: 2718 - protein, 7 aa, Artificial Sequence
  Description of Artificial Sequence: example ZFP
RSDNLTR

SEQ ID NO: 2719 - protein, 7 aa, Artificial Sequence
  Description of Artificial Sequence: example ZFP
QSGSLTR

SEQ ID NO: 2720 - protein, 7 aa, Artificial Sequence
  Description of Artificial Sequence: example ZFP
RSDHLTT

SEQ ID NO: 2721 - protein, 7 aa, Artificial Sequence
  Description of Artificial Sequence: example ZFP
QSGHLAR

SEQ ID NO: 2722 - protein, 7 aa, Artificial Sequence
  Description of Artificial Sequence: example ZFP
QRAHLAR

SEQ ID NO: 2723 - protein, 7 aa, Artificial Sequence
  Description of Artificial Sequence: example ZFP
RSDNLTT

SEQ ID NO: 2724 - protein, 7 aa, Artificial Sequence
  Description of Artificial Sequence: example ZFP
QSANLAR

SEQ ID NO: 2725 - protein, 7 aa, Artificial Sequence
  Description of Artificial Sequence: example ZFP
QSANLAR

SEQ ID NO: 2726 - protein, 7 aa, Artificial Sequence
  Description of Artificial Sequence: example ZFP
QSANLAR

SEQ ID NO: 2727 - protein, 7 aa, Artificial Sequence
  Description of Artificial Sequence: example ZFP
QSANLAR

SEQ ID NO: 2728 - protein, 7 aa, Artificial Sequence
  Description of Artificial Sequence: example ZFP
DRSHLAR

SEQ ID NO: 2729 - protein, 7 aa, Artificial Sequence
  Description of Artificial Sequence: example ZFP
DRSHLAR

SEQ ID NO: 2730 - protein, 7 aa, Artificial Sequence
  Description of Artificial Sequence: example ZFP
QSGALTR

SEQ ID NO: 2731 - protein, 7 aa, Artificial Sequence
  Description of Artificial Sequence: example ZFP
ERGDLTR

SEQ ID NO: 2732 - protein, 7 aa, Artificial Sequence
  Description of Artificial Sequence: example ZFP
ERGDLTR

SEQ ID NO: 2733 - protein, 7 aa, Artificial Sequence
  Description of Artificial Sequence: example ZFP
RSDALTR

SEQ ID NO: 2734 - protein, 7 aa, Artificial Sequence
  Description of Artificial Sequence: example ZFP
RSDALTR

SEQ ID NO: 2735 - protein, 7 aa, Artificial Sequence
  Description of Artificial Sequence: example ZFP
RSDALTR

SEQ ID NO: 2736 - protein, 7 aa, Artificial Sequence
  Description of Artificial Sequence: example ZFP
RSDALRE

SEQ ID NO: 2737 - protein, 7 aa, Artificial Sequence
  Description of Artificial Sequence: example ZFP
DRSNLTR

SEQ ID NO: 2738 - protein, 7 aa, Artificial Sequence
  Description of Artificial Sequence: example ZFP
QSSDLRR

SEQ ID NO: 2739 - protein, 7 aa, Artificial Sequence
  Description of Artificial Sequence: example ZFP
RSDDLRT

SEQ ID NO: 2740 - protein, 7 aa, Artificial Sequence
  Description of Artificial Sequence: example ZFP
RSDNLTR

SEQ ID NO: 2741 - protein, 7 aa, Artificial Sequence
  Description of Artificial Sequence: example ZFP
RSDHLSR

SEQ ID NO: 2742 - protein, 7 aa, Artificial Sequence
  Description of Artificial Sequence: example ZFP
RSDHLSR

SEQ ID NO: 2743 - protein, 7 aa, Artificial Sequence
  Description of Artificial Sequence: example ZFP
DRSDLTR

SEQ ID NO: 2744 - protein, 7 aa, Artificial Sequence
  Description of Artificial Sequence: example ZFP
DRSDLTR

SEQ ID NO: 2745 - protein, 7 aa, Artificial Sequence
  Description of Artificial Sequence: example ZFP
QSGSLTR

SEQ ID NO: 2746 - protein, 7 aa, Artificial Sequence
  Description of Artificial Sequence: example ZFP
DRSHLAR

SEQ ID NO: 2747 - protein, 7 aa, Artificial Sequence
  Description of Artificial Sequence: example ZFP
RSSNLRE

SEQ ID NO: 2748 - protein, 7 aa, Artificial Sequence
  Description of Artificial Sequence: example ZFP
QSGHLNQ

SEQ ID NO: 2749 - protein, 7 aa, Artificial Sequence
  Description of Artificial Sequence: example ZFP
RSDALRQ

SEQ ID NO: 2750 - protein, 7 aa, Artificial Sequence
  Description of Artificial Sequence: example ZFP
DRSHLAR

SEQ ID NO: 2751 - protein, 7 aa, Artificial Sequence
  Description of Artificial Sequence: example ZFP
DRSHLAR

SEQ ID NO: 2752 - protein, 7 aa, Artificial Sequence
  Description of Artificial Sequence: example ZFP
KNWKLQA

SEQ ID NO: 2753 - protein, 7 aa, Artificial Sequence
  Description of Artificial Sequence: example ZFP
KNWKLQA

SEQ ID NO: 2754 - protein, 7 aa, Artificial Sequence
  Description of Artificial Sequence: example ZFP
RSDSLLR

SEQ ID NO: 2755 - protein, 7 aa, Artificial Sequence
  Description of Artificial Sequence: example ZFP
DRSHLAR

SEQ ID NO: 2756 - protein, 7 aa, Artificial Sequence
  Description of Artificial Sequence: example ZFP
RSDHLTT

SEQ ID NO: 2757 - protein, 7 aa, Artificial Sequence
  Description of Artificial Sequence: example ZFP
QSANLAR

SEQ ID NO: 2758 - protein, 7 aa, Artificial Sequence
  Description of Artificial Sequence: example ZFP
RSDALTR

SEQ ID NO: 2759 - protein, 7 aa, Artificial Sequence
  Description of Artificial Sequence: example ZFP
RSDALTR

SEQ ID NO: 2760 - protein, 7 aa, Artificial Sequence
  Description of Artificial Sequence: example ZFP
RSDALTR

SEQ ID NO: 2761 - protein, 7 aa, Artificial Sequence
  Description of Artificial Sequence: example ZFP
RSDALTR

SEQ ID NO: 2762 - protein, 7 aa, Artificial Sequence
  Description of Artificial Sequence: example ZFP
RSDALTR

SEQ ID NO: 2763 - protein, 7 aa, Artificial Sequence
  Description of Artificial Sequence: example ZFP
RSDALTR

SEQ ID NO: 2764 - protein, 7 aa, Artificial Sequence
  Description of Artificial Sequence: example ZFP
ERGDLTR

SEQ ID NO: 2765 - protein, 7 aa, Artificial Sequence
  Description of Artificial Sequence: example ZFP
RSDNRTA

SEQ ID NO: 2766 - protein, 7 aa, Artificial Sequence
  Description of Artificial Sequence: example ZFP
RSDNRTA

SEQ ID NO: 2767 - protein, 7 aa, Artificial Sequence
  Description of Artificial Sequence: example ZFP
RSDNRTA

SEQ ID NO: 2768 - protein, 7 aa, Artificial Sequence
  Description of Artificial Sequence: example ZFP
DRSNLRT

SEQ ID NO: 2769 - protein, 7 aa, Artificial Sequence
  Description of Artificial Sequence: example ZFP
RSDALRE

SEQ ID NO: 2770 - protein, 7 aa, Artificial Sequence
  Description of Artificial Sequence: example ZFP
RSDALRE

SEQ ID NO: 2771 - protein, 7 aa, Artificial Sequence
  Description of Artificial Sequence: example ZFP
QSSDLRR

SEQ ID NO: 2772 - protein, 7 aa, Artificial Sequence
  Description of Artificial Sequence: example ZFP
TTSALTR

SEQ ID NO: 2773 - protein, 7 aa, Artificial Sequence
  Description of Artificial Sequence: example ZFP
QRAHLER

SEQ ID NO: 2774 - protein, 7 aa, Artificial Sequence
  Description of Artificial Sequence: example ZFP
RSDELTR

SEQ ID NO: 2775 - protein, 7 aa, Artificial Sequence
  Description of Artificial Sequence: example ZFP
RSDNLRE

SEQ ID NO: 2776 - protein, 7 aa, Artificial Sequence
  Description of Artificial Sequence: example ZFP
TTSALTR

SEQ ID NO: 2777 - protein, 7 aa, Artificial Sequence
  Description of Artificial Sequence: example ZFP
RSDNLTR

SEQ ID NO: 2778 - protein, 7 aa, Artificial Sequence
  Description of Artificial Sequence: example ZFP
TTSALTR

SEQ ID NO: 2779 - protein, 7 aa, Artificial Sequence
  Description of Artificial Sequence: example ZFP
QSSDLRR

SEQ ID NO: 2780 - protein, 7 aa, Artificial Sequence
  Description of Artificial Sequence: example ZFP
QSGSLTR

SEQ ID NO: 2781 - protein, 7 aa, Artificial Sequence
  Description of Artificial Sequence: example ZFP
RSDHLTQ

SEQ ID NO: 2782 - protein, 7 aa, Artificial Sequence
  Description of Artificial Sequence: example ZFP
RSDHLTQ

SEQ ID NO: 2783 - protein, 7 aa, Artificial Sequence
  Description of Artificial Sequence: example ZFP
RSDHLTQ

SEQ ID NO: 2784 - protein, 7 aa, Artificial Sequence
  Description of Artificial Sequence: example ZFP
RSDHLTQ

SEQ ID NO: 2785 - protein, 7 aa, Artificial Sequence
  Description of Artificial Sequence: example ZFP
DRSHLAR

SEQ ID NO: 2786 - protein, 7 aa, Artificial Sequence
  Description of Artificial Sequence: example ZFP
RSDALTK

SEQ ID NO: 2787 - protein, 7 aa, Artificial Sequence
  Description of Artificial Sequence: example ZFP
RADALMV

SEQ ID NO: 2788 - protein, 7 aa, Artificial Sequence
  Description of Artificial Sequence: example ZFP
RSDHLSR

SEQ ID NO: 2789 - protein, 7 aa, Artificial Sequence
  Description of Artificial Sequence: example ZFP
RSDNLAR

SEQ ID NO: 2790 - protein, 7 aa, Artificial Sequence
  Description of Artificial Sequence: example ZFP
RSDELTR

SEQ ID NO: 2791 - protein, 7 aa, Artificial Sequence
  Description of Artificial Sequence: example ZFP
DRSNLTR

SEQ ID NO: 2792 - protein, 7 aa, Artificial Sequence
  Description of Artificial Sequence: example ZFP
DRSNLTR

SEQ ID NO: 2793 - protein, 7 aa, Artificial Sequence
  Description of Artificial Sequence: example ZFP
RSDALRE

SEQ ID NO: 2794 - protein, 7 aa, Artificial Sequence
  Description of Artificial Sequence: example ZFP
RSDALRE

SEQ ID NO: 2795 - protein, 7 aa, Artificial Sequence
  Description of Artificial Sequence: example ZFP
QSGSLTR

SEQ ID NO: 2796 - protein, 7 aa, Artificial Sequence
  Description of Artificial Sequence: example ZFP
QSGSLTR

SEQ ID NO: 2797 - protein, 7 aa, Artificial Sequence
  Description of Artificial Sequence: example ZFP
RSDNLAR

SEQ ID NO: 2798 - protein, 7 aa, Artificial Sequence
  Description of Artificial Sequence: example ZFP
QSSALAR

SEQ ID NO: 2799 - protein, 7 aa, Artificial Sequence
  Description of Artificial Sequence: example ZFP
RSDALTR

SEQ ID NO: 2800 - protein, 7 aa, Artificial Sequence
  Description of Artificial Sequence: example ZFP
QSGSLTR

SEQ ID NO: 2801 - protein, 7 aa, Artificial Sequence
  Description of Artificial Sequence: example ZFP
QSHDLTK

SEQ ID NO: 2802 - protein, 7 aa, Artificial Sequence
  Description of Artificial Sequence: example ZFP
QSANLAR

SEQ ID NO: 2803 - protein, 7 aa, Artificial Sequence
  Description of Artificial Sequence: example ZFP
QSANLAR

SEQ ID NO: 2804 - protein, 7 aa, Artificial Sequence
  Description of Artificial Sequence: example ZFP
RSDALTR

SEQ ID NO: 2805 - protein, 7 aa, Artificial Sequence
  Description of Artificial Sequence: example ZFP
RSDALTR

SEQ ID NO: 2806 - protein, 7 aa, Artificial Sequence
  Description of Artificial Sequence: example ZFP
RSDELTR

SEQ ID NO: 2807 - protein, 7 aa, Artificial Sequence
  Description of Artificial Sequence: example ZFP
RSDELTR

SEQ ID NO: 2808 - protein, 7 aa, Artificial Sequence
  Description of Artificial Sequence: example ZFP
QSGALTR

SEQ ID NO: 2809 - protein, 7 aa, Artificial Sequence
  Description of Artificial Sequence: example ZFP
RSDELTR

SEQ ID NO: 2810 - protein, 7 aa, Artificial Sequence
  Description of Artificial Sequence: example ZFP
RSDNLAR

SEQ ID NO: 2811 - protein, 7 aa, Artificial Sequence
  Description of Artificial Sequence: example ZFP
QRAHLER

SEQ ID NO: 2812 - protein, 7 aa, Artificial Sequence
  Description of Artificial Sequence: example ZFP
RSDELTR

SEQ ID NO: 2813 - protein, 7 aa, Artificial Sequence
  Description of Artificial Sequence: example ZFP
RSDNLTT

SEQ ID NO: 2814 - protein, 7 aa, Artificial Sequence
  Description of Artificial Sequence: example ZFP
QSSNLAR

SEQ ID NO: 2815 - protein, 7 aa, Artificial Sequence
  Description of Artificial Sequence: example ZFP
TTSNLAR

SEQ ID NO: 2816 - protein, 7 aa, Artificial Sequence
  Description of Artificial Sequence: example ZFP
QSSNLRR

SEQ ID NO: 2817 - protein, 7 aa, Artificial Sequence
  Description of Artificial Sequence: example ZFP
RSDSLLR

SEQ ID NO: 2818 - protein, 7 aa, Artificial Sequence
  Description of Artificial Sequence: example ZFP
RLDSLLR

SEQ ID NO: 2819 - protein, 7 aa, Artificial Sequence
  Description of Artificial Sequence: example ZFP
QSGDLTR

SEQ ID NO: 2820 - protein, 7 aa, Artificial Sequence
  Description of Artificial Sequence: example ZFP
QSGDLTR

SEQ ID NO: 2821 - protein, 7 aa, Artificial Sequence
  Description of Artificial Sequence: example ZFP
QSGDLTR

SEQ ID NO: 2822 - protein, 7 aa, Artificial Sequence
  Description of Artificial Sequence: example ZFP
TTSALTR

SEQ ID NO: 2823 - protein, 7 aa, Artificial Sequence
  Description of Artificial Sequence: example ZFP
TTSALTR

SEQ ID NO: 2824 - protein, 7 aa, Artificial Sequence
  Description of Artificial Sequence: example ZFP
DRSHLTR

SEQ ID NO: 2825 - protein, 7 aa, Artificial Sequence
  Description of Artificial Sequence: example ZFP
DRSALTR

SEQ ID NO: 2826 - protein, 7 aa, Artificial Sequence
  Description of Artificial Sequence: example ZFP
QSSDLTR

SEQ ID NO: 2827 - protein, 7 aa, Artificial Sequence
  Description of Artificial Sequence: example ZFP
QSSDLTR

SEQ ID NO: 2828 - protein, 7 aa, Artificial Sequence
  Description of Artificial Sequence: example ZFP
QSGHLAR

SEQ ID NO: 2829 - protein, 7 aa, Artificial Sequence
  Description of Artificial Sequence: example ZFP
RSDALRE

SEQ ID NO: 2830 - protein, 7 aa, Artificial Sequence
  Description of Artificial Sequence: example ZFP
DRSSLTT

SEQ ID NO: 2831 - protein, 7 aa, Artificial Sequence
  Description of Artificial Sequence: example ZFP
ERGDLTT

SEQ ID NO: 2832 - protein, 7 aa, Artificial Sequence
  Description of Artificial Sequence: example ZFP
QSANLSR

SEQ ID NO: 2833 - protein, 7 aa, Artificial Sequence
  Description of Artificial Sequence: example ZFP
QRSNLVR

SEQ ID NO: 2834 - protein, 7 aa, Artificial Sequence
  Description of Artificial Sequence: example ZFP
RSDNLAR

SEQ ID NO: 2835 - protein, 7 aa, Artificial Sequence
  Description of Artificial Sequence: example ZFP
RSDHLAR

SEQ ID NO: 2836 - protein, 7 aa, Artificial Sequence
  Description of Artificial Sequence: example ZFP
QSGSLTR

SEQ ID NO: 2837 - protein, 7 aa, Artificial Sequence
  Description of Artificial Sequence: example ZFP
QSGDLRT

SEQ ID NO: 2838 - protein, 7 aa, Artificial Sequence
  Description of Artificial Sequence: example ZFP
ERGDLTR

SEQ ID NO: 2839 - protein, 7 aa, Artificial Sequence
  Description of Artificial Sequence: example ZFP
QSGHLAR

SEQ ID NO: 2840 - protein, 7 aa, Artificial Sequence
  Description of Artificial Sequence: example ZFP
DRSHLTR

SEQ ID NO: 2841 - protein, 7 aa, Artificial Sequence
  Description of Artificial Sequence: example ZFP
DRSALTR

SEQ ID NO: 2842 - protein, 7 aa, Artificial Sequence
  Description of Artificial Sequence: example ZFP
QSGALTQ

SEQ ID NO: 2843 - protein, 7 aa, Artificial Sequence
  Description of Artificial Sequence: example ZFP
QQASLNA

SEQ ID NO: 2844 - protein, 7 aa, Artificial Sequence
  Description of Artificial Sequence: example ZFP
QSGHLAR

SEQ ID NO: 2845 - protein, 7 aa, Artificial Sequence
  Description of Artificial Sequence: example ZFP
TSGHLVR

SEQ ID NO: 2846 - protein, 7 aa, Artificial Sequence
  Description of Artificial Sequence: example ZFP
MSHHLSR

SEQ ID NO: 2847 - protein, 7 aa, Artificial Sequence
  Description of Artificial Sequence: example ZFP
DRSSLTT

SEQ ID NO: 2848 - protein, 7 aa, Artificial Sequence
  Description of Artificial Sequence: example ZFP
ERGDLTT

SEQ ID NO: 2849 - protein, 7 aa, Artificial Sequence
  Description of Artificial Sequence: example ZFP
RSDNLAR

SEQ ID NO: 2850 - protein, 7 aa, Artificial Sequence
  Description of Artificial Sequence: example ZFP
RSDLATR

SEQ ID NO: 2851 - protein, 7 aa, Artificial Sequence
  Description of Artificial Sequence: example ZFP
QSGALTR

SEQ ID NO: 2852 - protein, 7 aa, Artificial Sequence
  Description of Artificial Sequence: example ZFP
QSGHLTR

SEQ ID NO: 2853 - protein, 7 aa, Artificial Sequence
  Description of Artificial Sequence: example ZFP
QRSALAS

SEQ ID NO: 2854 - protein, 7 aa, Artificial Sequence
  Description of Artificial Sequence: example ZFP
RSDALTT

SEQ ID NO: 2855 - protein, 7 aa, Artificial Sequence
  Description of Artificial Sequence: example ZFP
ERGTLAR

SEQ ID NO: 2856 - protein, 7 aa, Artificial Sequence
  Description of Artificial Sequence: example ZFP
QSSALAS

SEQ ID NO: 2857 - protein, 7 aa, Artificial Sequence
  Description of Artificial Sequence: example ZFP
TTSALAS

SEQ ID NO: 2858 - protein, 7 aa, Artificial Sequence
  Description of Artificial Sequence: example ZFP
ERGDLAR

SEQ ID NO: 2859 - protein, 7 aa, Artificial Sequence
  Description of Artificial Sequence: example ZFP
QSGHLTK

SEQ ID NO: 2860 - protein, 7 aa, Artificial Sequence
  Description of Artificial Sequence: example ZFP
QSGHLTT

SEQ ID NO: 2861 - protein, 7 aa, Artificial Sequence
  Description of Artificial Sequence: example ZFP
RSDNLTT

SEQ ID NO: 2862 - protein, 7 aa, Artificial Sequence
  Description of Artificial Sequence: example ZFP
RSDNLTT

SEQ ID NO: 2863 - protein, 7 aa, Artificial Sequence
  Description of Artificial Sequence: example ZFP
TSSHLAS

SEQ ID NO: 2864 - protein, 7 aa, Artificial Sequence
  Description of Artificial Sequence: example ZFP
MSHHLTT

SEQ ID NO: 2865 - protein, 7 aa, Artificial Sequence
  Description of Artificial Sequence: example ZFP
RSDNLAR

SEQ ID NO: 2866 - protein, 7 aa, Artificial Sequence
  Description of Artificial Sequence: example ZFP
RSDNLAR

SEQ ID NO: 2867 - protein, 7 aa, Artificial Sequence
  Description of Artificial Sequence: example ZFP
QSGALTQ

SEQ ID NO: 2868 - protein, 7 aa, Artificial Sequence
  Description of Artificial Sequence: example ZFP
QLTGLNQ

SEQ ID NO: 2869 - protein, 7 aa, Artificial Sequence
  Description of Artificial Sequence: example ZFP
QQASLNA

SEQ ID NO: 2870 - protein, 7 aa, Artificial Sequence
  Description of Artificial Sequence: example ZFP
TSGHLVR

SEQ ID NO: 2871 - protein, 7 aa, Artificial Sequence
  Description of Artificial Sequence: example ZFP
TSGHLVR

SEQ ID NO: 2872 - protein, 7 aa, Artificial Sequence
  Description of Artificial Sequence: example ZFP
TSGHLVR

SEQ ID NO: 2873 - protein, 7 aa, Artificial Sequence
  Description of Artificial Sequence: example ZFP
TSGHLVR

SEQ ID NO: 2874 - protein, 7 aa, Artificial Sequence
  Description of Artificial Sequence: example ZFP
RSDHLTT

SEQ ID NO: 2875 - protein, 7 aa, Artificial Sequence
  Description of Artificial Sequence: example ZFP
QSGHLTT

SEQ ID NO: 2876 - protein, 7 aa, Artificial Sequence
  Description of Artificial Sequence: example ZFP
RSDHLTT

SEQ ID NO: 2877 - protein, 7 aa, Artificial Sequence
  Description of Artificial Sequence: example ZFP
RSDALRE

SEQ ID NO: 2878 - protein, 7 aa, Artificial Sequence
  Description of Artificial Sequence: example ZFP
DRSHLTR

SEQ ID NO: 2879 - protein, 7 aa, Artificial Sequence
  Description of Artificial Sequence: example ZFP
QSGHLAR

SEQ ID NO: 2880 - protein, 7 aa, Artificial Sequence
  Description of Artificial Sequence: example ZFP
QSSHLAR

SEQ ID NO: 2881 - protein, 7 aa, Artificial Sequence
  Description of Artificial Sequence: example ZFP
RSDELTR

SEQ ID NO: 2882 - protein, 7 aa, Artificial Sequence
  Description of Artificial Sequence: example ZFP
RSDELTR

SEQ ID NO: 2883 - protein, 7 aa, Artificial Sequence
  Description of Artificial Sequence: example ZFP
RSDELTR

SEQ ID NO: 2884 - protein, 7 aa, Artificial Sequence
  Description of Artificial Sequence: example ZFP
RSDELTR

SEQ ID NO: 2885 - protein, 7 aa, Artificial Sequence
  Description of Artificial Sequence: example ZFP
RSDNLRE

SEQ ID NO: 2886 - protein, 7 aa, Artificial Sequence
  Description of Artificial Sequence: example ZFP
RSDNLTT

SEQ ID NO: 2887 - protein, 7 aa, Artificial Sequence
  Description of Artificial Sequence: example ZFP
DRSNLTR

SEQ ID NO: 2888 - protein, 7 aa, Artificial Sequence
  Description of Artificial Sequence: example ZFP
QSGHLTT

SEQ ID NO: 2889 - protein, 7 aa, Artificial Sequence
  Description of Artificial Sequence: example ZFP
RSDALTS

SEQ ID NO: 2890 - protein, 7 aa, Artificial Sequence
  Description of Artificial Sequence: example ZFP
RSDALTA

SEQ ID NO: 2891 - protein, 7 aa, Artificial Sequence
  Description of Artificial Sequence: example ZFP
RSDALTQ

SEQ ID NO: 2892 - protein, 7 aa, Artificial Sequence
  Description of Artificial Sequence: example ZFP
RSDALRE

SEQ ID NO: 2893 - protein, 7 aa, Artificial Sequence
  Description of Artificial Sequence: example ZFP
DRSALAR

SEQ ID NO: 2894 - protein, 7 aa, Artificial Sequence
  Description of Artificial Sequence: example ZFP
QSGHLNQ

SEQ ID NO: 2895 - protein, 7 aa, Artificial Sequence
  Description of Artificial Sequence: example ZFP
KNWKLQA

SEQ ID NO: 2896 - protein, 7 aa, Artificial Sequence
  Description of Artificial Sequence: example ZFP
QSGSLTR

SEQ ID NO: 2897 - protein, 7 aa, Artificial Sequence
  Description of Artificial Sequence: example ZFP
QSGSLTR

SEQ ID NO: 2898 - protein, 7 aa, Artificial Sequence
  Description of Artificial Sequence: example ZFP
QSSSLVR

SEQ ID NO: 2899 - protein, 7 aa, Artificial Sequence
  Description of Artificial Sequence: example ZFP
QSSSLVR

SEQ ID NO: 2900 - protein, 7 aa, Artificial Sequence
  Description of Artificial Sequence: example ZFP
QSGHLTT

SEQ ID NO: 2901 - protein, 7 aa, Artificial Sequence
  Description of Artificial Sequence: example ZFP
QKTNLDT

SEQ ID NO: 2902 - protein, 7 aa, Artificial Sequence
  Description of Artificial Sequence: example ZFP
QSGNLNQ

SEQ ID NO: 2903 - protein, 7 aa, Artificial Sequence
  Description of Artificial Sequence: example ZFP
QKTNLDT

SEQ ID NO: 2904 - protein, 7 aa, Artificial Sequence
  Description of Artificial Sequence: example ZFP
QSANLSR

SEQ ID NO: 2905 - protein, 7 aa, Artificial Sequence
  Description of Artificial Sequence: example ZFP
QRSNLVR

SEQ ID NO: 2906 - protein, 7 aa, Artificial Sequence
  Description of Artificial Sequence: example ZFP
QSANLSR

SEQ ID NO: 2907 - protein, 7 aa, Artificial Sequence
  Description of Artificial Sequence: example ZFP
QRSNLVR

SEQ ID NO: 2908 - protein, 7 aa, Artificial Sequence
  Description of Artificial Sequence: example ZFP
QSSNLAR

SEQ ID NO: 2909 - protein, 7 aa, Artificial Sequence
  Description of Artificial Sequence: example ZFP
QSSNLAR

SEQ ID NO: 2910 - protein, 7 aa, Artificial Sequence
  Description of Artificial Sequence: example ZFP
DRSHLTR

SEQ ID NO: 2911 - protein, 7 aa, Artificial Sequence
  Description of Artificial Sequence: example ZFP
RSDALTR

SEQ ID NO: 2912 - protein, 7 aa, Artificial Sequence
  Description of Artificial Sequence: example ZFP
RSDALTR

SEQ ID NO: 2913 - protein, 7 aa, Artificial Sequence
  Description of Artificial Sequence: example ZFP
RSDALTR

SEQ ID NO: 2914 - protein, 7 aa, Artificial Sequence
  Description of Artificial Sequence: example ZFP
RSDALTR

SEQ ID NO: 2915 - protein, 7 aa, Artificial Sequence
  Description of Artificial Sequence: example ZFP
RSDALTR

SEQ ID NO: 2916 - protein, 7 aa, Artificial Sequence
  Description of Artificial Sequence: example ZFP
RSDALTR

SEQ ID NO: 2917 - protein, 7 aa, Artificial Sequence
  Description of Artificial Sequence: example ZFP
QSSHLTR

SEQ ID NO: 2918 - protein, 7 aa, Artificial Sequence
  Description of Artificial Sequence: example ZFP
QSSHLTR

SEQ ID NO: 2919 - protein, 7 aa, Artificial Sequence
  Description of Artificial Sequence: example ZFP
QSSHLTR

SEQ ID NO: 2920 - protein, 7 aa, Artificial Sequence
  Description of Artificial Sequence: example ZFP
QSSHLTR

SEQ ID NO: 2921 - protein, 7 aa, Artificial Sequence
  Description of Artificial Sequence: example ZFP
DRSHLTR

SEQ ID NO: 2922 - protein, 7 aa, Artificial Sequence
  Description of Artificial Sequence: example ZFP
QSGHLNQ

SEQ ID NO: 2923 - protein, 7 aa, Artificial Sequence
  Description of Artificial Sequence: example ZFP
ENWKLQA

SEQ ID NO: 2924 - protein, 7 aa, Artificial Sequence
  Description of Artificial Sequence: example ZFP
RSDHLTT

SEQ ID NO: 2925 - protein, 7 aa, Artificial Sequence
  Description of Artificial Sequence: example ZFP
QSSDLRR

SEQ ID NO: 2926 - protein, 7 aa, Artificial Sequence
  Description of Artificial Sequence: example ZFP
QSSDLRR

SEQ ID NO: 2927 - protein, 7 aa, Artificial Sequence
  Description of Artificial Sequence: example ZFP
QSGHLQR

SEQ ID NO: 2928 - protein, 7 aa, Artificial Sequence
  Description of Artificial Sequence: example ZFP
QRAHLAR

SEQ ID NO: 2929 - protein, 7 aa, Artificial Sequence
  Description of Artificial Sequence: example ZFP
QSSHLAR

SEQ ID NO: 2930 - protein, 7 aa, Artificial Sequence
  Description of Artificial Sequence: example ZFP
RSDHLSR

SEQ ID NO: 2931 - protein, 7 aa, Artificial Sequence
  Description of Artificial Sequence: example ZFP
TKQHLKT

SEQ ID NO: 2932 - protein, 7 aa, Artificial Sequence
  Description of Artificial Sequence: example ZFP
RSDNLAR

SEQ ID NO: 2933 - protein, 7 aa, Artificial Sequence
  Description of Artificial Sequence: example ZFP
ERGTLAR

SEQ ID NO: 2934 - protein, 7 aa, Artificial Sequence
  Description of Artificial Sequence: example ZFP
RGDALTS

SEQ ID NO: 2935 - protein, 7 aa, Artificial Sequence
  Description of Artificial Sequence: example ZFP
RSDALTQ

SEQ ID NO: 2936 - protein, 7 aa, Artificial Sequence
  Description of Artificial Sequence: example ZFP
RSDHLSR

SEQ ID NO: 2937 - protein, 7 aa, Artificial Sequence
  Description of Artificial Sequence: example ZFP
RSDHLSR

SEQ ID NO: 2938 - protein, 7 aa, Artificial Sequence
  Description of Artificial Sequence: example ZFP
RSDNLAR

SEQ ID NO: 2939 - protein, 7 aa, Artificial Sequence
  Description of Artificial Sequence: example ZFP
QSGSLTR

SEQ ID NO: 2940 - protein, 7 aa, Artificial Sequence
  Description of Artificial Sequence: example ZFP
RSDHLSR

SEQ ID NO: 2941 - protein, 7 aa, Artificial Sequence
  Description of Artificial Sequence: example ZFP
RSDHLSR

SEQ ID NO: 2942 - protein, 7 aa, Artificial Sequence
  Description of Artificial Sequence: example ZFP
RSDELTR

SEQ ID NO: 2943 - protein, 7 aa, Artificial Sequence
  Description of Artificial Sequence: example ZFP
RSDNLAR

SEQ ID NO: 2944 - protein, 7 aa, Artificial Sequence
  Description of Artificial Sequence: example ZFP
RSDSLLR

SEQ ID NO: 2945 - protein, 7 aa, Artificial Sequence
  Description of Artificial Sequence: example ZFP
RSDELTR

SEQ ID NO: 2946 - protein, 7 aa, Artificial Sequence
  Description of Artificial Sequence: example ZFP
RSDELTR

SEQ ID NO: 2947 - protein, 7 aa, Artificial Sequence
  Description of Artificial Sequence: example ZFP
RSDNLAR

SEQ ID NO: 2948 - protein, 7 aa, Artificial Sequence
  Description of Artificial Sequence: example ZFP
RSDNLAR

SEQ ID NO: 2949 - protein, 7 aa, Artificial Sequence
  Description of Artificial Sequence: example ZFP
ERGTLAR

SEQ ID NO: 2950 - protein, 7 aa, Artificial Sequence
  Description of Artificial Sequence: example ZFP
RADALMV

SEQ ID NO: 2951 - protein, 7 aa, Artificial Sequence
  Description of Artificial Sequence: example ZFP
RSDELTR

SEQ ID NO: 2952 - protein, 7 aa, Artificial Sequence
  Description of Artificial Sequence: example ZFP
RSDELTR

SEQ ID NO: 2953 - protein, 7 aa, Artificial Sequence
  Description of Artificial Sequence: example ZFP
RSDELRE

SEQ ID NO: 2954 - protein, 7 aa, Artificial Sequence
  Description of Artificial Sequence: example ZFP
RSDDLRE

SEQ ID NO: 2955 - protein, 7 aa, Artificial Sequence
  Description of Artificial Sequence: example ZFP
RSDNLAR

SEQ ID NO: 2956 - protein, 7 aa, Artificial Sequence
  Description of Artificial Sequence: example ZFP
RSDNLAR

SEQ ID NO: 2957 - protein, 7 aa, Artificial Sequence
  Description of Artificial Sequence: example ZFP
ERGTLAR

SEQ ID NO: 2958 - protein, 7 aa, Artificial Sequence
  Description of Artificial Sequence: example ZFP
ERGTLAR

SEQ ID NO: 2959 - protein, 7 aa, Artificial Sequence
  Description of Artificial Sequence: example ZFP
ERGTLAR

SEQ ID NO: 2960 - protein, 7 aa, Artificial Sequence
  Description of Artificial Sequence: example ZFP
RSDSLLR

SEQ ID NO: 2961 - protein, 7 aa, Artificial Sequence
  Description of Artificial Sequence: example ZFP
RSDHLSR

SEQ ID NO: 2962 - protein, 7 aa, Artificial Sequence
  Description of Artificial Sequence: example ZFP
TSDHLAS

SEQ ID NO: 2963 - protein, 7 aa, Artificial Sequence
  Description of Artificial Sequence: example ZFP
QRSALAS

SEQ ID NO: 2964 - protein, 7 aa, Artificial Sequence
  Description of Artificial Sequence: example ZFP
QSGALTK

SEQ ID NO: 2965 - protein, 7 aa, Artificial Sequence
  Description of Artificial Sequence: example ZFP
RSDHLSR

SEQ ID NO: 2966 - protein, 7 aa, Artificial Sequence
  Description of Artificial Sequence: example ZFP
ERGTLAR

SEQ ID NO: 2967 - protein, 7 aa, Artificial Sequence
  Description of Artificial Sequence: example ZFP
QSGNLAR

SEQ ID NO: 2968 - protein, 7 aa, Artificial Sequence
  Description of Artificial Sequence: example ZFP
QSGNLAR

SEQ ID NO: 2969 - protein, 7 aa, Artificial Sequence
  Description of Artificial Sequence: example ZFP
QSGNLAR

SEQ ID NO: 2970 - protein, 7 aa, Artificial Sequence
  Description of Artificial Sequence: example ZFP
QSGNLAR

SEQ ID NO: 2971 - protein, 7 aa, Artificial Sequence
  Description of Artificial Sequence: example ZFP
QSSDLRR

SEQ ID NO: 2972 - protein, 7 aa, Artificial Sequence
  Description of Artificial Sequence: example ZFP
QSANLSR

SEQ ID NO: 2973 - protein, 7 aa, Artificial Sequence
  Description of Artificial Sequence: example ZFP
QSSDLRR

SEQ ID NO: 2974 - protein, 7 aa, Artificial Sequence
  Description of Artificial Sequence: example ZFP
QSANLSR

SEQ ID NO: 2975 - protein, 7 aa, Artificial Sequence
  Description of Artificial Sequence: example ZFP
RSDNLAR

SEQ ID NO: 2976 - protein, 7 aa, Artificial Sequence
  Description of Artificial Sequence: example ZFP
RSANLAR

SEQ ID NO: 2977 - protein, 7 aa, Artificial Sequence
  Description of Artificial Sequence: example ZFP
QSGNLAR

SEQ ID NO: 2978 - protein, 7 aa, Artificial Sequence
  Description of Artificial Sequence: example ZFP
TTSALTR

SEQ ID NO: 2979 - protein, 7 aa, Artificial Sequence
  Description of Artificial Sequence: example ZFP
RSDNLAR

SEQ ID NO: 2980 - protein, 7 aa, Artificial Sequence
  Description of Artificial Sequence: example ZFP
TTSALTR

SEQ ID NO: 2981 - protein, 7 aa, Artificial Sequence
  Description of Artificial Sequence: example ZFP
NRATLAR

SEQ ID NO: 2982 - protein, 7 aa, Artificial Sequence
  Description of Artificial Sequence: example ZFP
DRSALTR

SEQ ID NO: 2983 - protein, 7 aa, Artificial Sequence
  Description of Artificial Sequence: example ZFP
DRSALTR

SEQ ID NO: 2984 - protein, 7 aa, Artificial Sequence
  Description of Artificial Sequence: example ZFP
DRSALTR

SEQ ID NO: 2985 - protein, 7 aa, Artificial Sequence
  Description of Artificial Sequence: example ZFP
RSDHLSR

SEQ ID NO: 2986 - protein, 7 aa, Artificial Sequence
  Description of Artificial Sequence: example ZFP
TTSALTR

SEQ ID NO: 2987 - protein, 7 aa, Artificial Sequence
  Description of Artificial Sequence: example ZFP
TTSALTR

SEQ ID NO: 2988 - protein, 7 aa, Artificial Sequence
  Description of Artificial Sequence: example ZFP
QSSALAR

SEQ ID NO: 2989 - protein, 7 aa, Artificial Sequence
  Description of Artificial Sequence: example ZFP
QSSALAR

SEQ ID NO: 2990 - protein, 7 aa, Artificial Sequence
  Description of Artificial Sequence: example ZFP
QSSALAR

SEQ ID NO: 2991 - protein, 7 aa, Artificial Sequence
  Description of Artificial Sequence: example ZFP
RSDHLRE

SEQ ID NO: 2992 - protein, 7 aa, Artificial Sequence
  Description of Artificial Sequence: example ZFP
QSHDLTK

SEQ ID NO: 2993 - protein, 7 aa, Artificial Sequence
  Description of Artificial Sequence: example ZFP
NKTDLGK

SEQ ID NO: 2994 - protein, 7 aa, Artificial Sequence
  Description of Artificial Sequence: example ZFP
NKTDLGK

SEQ ID NO: 2995 - protein, 7 aa, Artificial Sequence
  Description of Artificial Sequence: example ZFP
DRSNLTR

SEQ ID NO: 2996 - protein, 7 aa, Artificial Sequence
  Description of Artificial Sequence: example ZFP
DRSNLTR

SEQ ID NO: 2997 - protein, 7 aa, Artificial Sequence
  Description of Artificial Sequence: example ZFP
QSSSLVR

SEQ ID NO: 2998 - protein, 7 aa, Artificial Sequence
  Description of Artificial Sequence: example ZFP
QSSDLRR

SEQ ID NO: 2999 - protein, 7 aa, Artificial Sequence
  Description of Artificial Sequence: example ZFP
DRSNLTR

SEQ ID NO: 3000 - protein, 7 aa, Artificial Sequence
  Description of Artificial Sequence: example ZFP
TTSALTR

SEQ ID NO: 3001 - protein, 7 aa, Artificial Sequence
  Description of Artificial Sequence: example ZFP
QSSDLRR

SEQ ID NO: 3002 - protein, 7 aa, Artificial Sequence
  Description of Artificial Sequence: example ZFP
RSDHLSR

SEQ ID NO: 3003 - protein, 7 aa, Artificial Sequence
  Description of Artificial Sequence: example ZFP
NKTDLGK

SEQ ID NO: 3004 - protein, 7 aa, Artificial Sequence
  Description of Artificial Sequence: example ZFP
RSDNLTT

SEQ ID NO: 3005 - protein, 7 aa, Artificial Sequence
  Description of Artificial Sequence: example ZFP
RSDNLTT

SEQ ID NO: 3006 - protein, 7 aa, Artificial Sequence
  Description of Artificial Sequence: example ZFP
DRSNLTR

SEQ ID NO: 3007 - protein, 7 aa, Artificial Sequence
  Description of Artificial Sequence: example ZFP
RSDNLAR

SEQ ID NO: 3008 - protein, 7 aa, Artificial Sequence
  Description of Artificial Sequence: example ZFP
QSSALAR

SEQ ID NO: 3009 - protein, 7 aa, Artificial Sequence
  Description of Artificial Sequence: example ZFP
QSSNLAR

SEQ ID NO: 3010 - protein, 7 aa, Artificial Sequence
  Description of Artificial Sequence: example ZFP
QSSNLAR

SEQ ID NO: 3011 - protein, 7 aa, Artificial Sequence
  Description of Artificial Sequence: example ZFP
QSGNLAR

SEQ ID NO: 3012 - protein, 7 aa, Artificial Sequence
  Description of Artificial Sequence: example ZFP
TSGHLVR

SEQ ID NO: 3013 - protein, 7 aa, Artificial Sequence
  Description of Artificial Sequence: example ZFP
QSGNLAR

SEQ ID NO: 3014 - protein, 7 aa, Artificial Sequence
  Description of Artificial Sequence: example ZFP
QSSHLAR

SEQ ID NO: 3015 - protein, 7 aa, Artificial Sequence
  Description of Artificial Sequence: example ZFP
RSDSLAR

SEQ ID NO: 3016 - protein, 7 aa, Artificial Sequence
  Description of Artificial Sequence: example ZFP
DRSALAR

SEQ ID NO: 3017 - protein, 7 aa, Artificial Sequence
  Description of Artificial Sequence: example ZFP
QSGNLQR

SEQ ID NO: 3018 - protein, 7 aa, Artificial Sequence
  Description of Artificial Sequence: example ZFP
QSGNLQR

SEQ ID NO: 3019 - protein, 7 aa, Artificial Sequence
  Description of Artificial Sequence: example ZFP
QSSHLAR

SEQ ID NO: 3020 - protein, 7 aa, Artificial Sequence
  Description of Artificial Sequence: example ZFP
RSDNLTR

SEQ ID NO: 3021 - protein, 7 aa, Artificial Sequence
  Description of Artificial Sequence: example ZFP
QSGNLAR

SEQ ID NO: 3022 - protein, 7 aa, Artificial Sequence
  Description of Artificial Sequence: example ZFP
QSGNLAR

SEQ ID NO: 3023 - protein, 7 aa, Artificial Sequence
  Description of Artificial Sequence: example ZFP
QSGNLAR

SEQ ID NO: 3024 - protein, 7 aa, Artificial Sequence
  Description of Artificial Sequence: example ZFP
RSDNLRT

SEQ ID NO: 3025 - protein, 7 aa, Artificial Sequence
  Description of Artificial Sequence: example ZFP
RSDSLAR

SEQ ID NO: 3026 - protein, 7 aa, Artificial Sequence
  Description of Artificial Sequence: example ZFP
DPGALVR

SEQ ID NO: 3027 - protein, 7 aa, Artificial Sequence
  Description of Artificial Sequence: example ZFP
DRSALAR

SEQ ID NO: 3028 - protein, 7 aa, Artificial Sequence
  Description of Artificial Sequence: example ZFP
DPGALVR

SEQ ID NO: 3029 - protein, 7 aa, Artificial Sequence
  Description of Artificial Sequence: example ZFP
RSDSLAR

SEQ ID NO: 3030 - protein, 7 aa, Artificial Sequence
  Description of Artificial Sequence: example ZFP
TSGSLTR

SEQ ID NO: 3031 - protein, 7 aa, Artificial Sequence
  Description of Artificial Sequence: example ZFP
QSSALTR

SEQ ID NO: 3032 - protein, 7 aa, Artificial Sequence
  Description of Artificial Sequence: example ZFP
QSATLAR

SEQ ID NO: 3033 - protein, 7 aa, Artificial Sequence
  Description of Artificial Sequence: example ZFP
QSSNLVR

SEQ ID NO: 3034 - protein, 7 aa, Artificial Sequence
  Description of Artificial Sequence: example ZFP
QSSNLVR

SEQ ID NO: 3035 - protein, 7 aa, Artificial Sequence
  Description of Artificial Sequence: example ZFP
RSDNLAR

SEQ ID NO: 3036 - protein, 7 aa, Artificial Sequence
  Description of Artificial Sequence: example ZFP
QSGNLQR

SEQ ID NO: 3037 - protein, 7 aa, Artificial Sequence
  Description of Artificial Sequence: example ZFP
QSSHLAR

SEQ ID NO: 3038 - protein, 7 aa, Artificial Sequence
  Description of Artificial Sequence: example ZFP
RSDHLTR

SEQ ID NO: 3039 - protein, 7 aa, Artificial Sequence
  Description of Artificial Sequence: example ZFP
RSDHLTR

SEQ ID NO: 3040 - protein, 7 aa, Artificial Sequence
  Description of Artificial Sequence: example ZFP
DRSHLAR

SEQ ID NO: 3041 - protein, 7 aa, Artificial Sequence
  Description of Artificial Sequence: example ZFP
DRSHLAR

SEQ ID NO: 3042 - protein, 7 aa, Artificial Sequence
  Description of Artificial Sequence: example ZFP
QSSDLRR

SEQ ID NO: 3043 - protein, 7 aa, Artificial Sequence
  Description of Artificial Sequence: example ZFP
QSSDLRR

SEQ ID NO: 3044 - protein, 7 aa, Artificial Sequence
  Description of Artificial Sequence: example ZFP
TSGELVR

SEQ ID NO: 3045 - protein, 7 aa, Artificial Sequence
  Description of Artificial Sequence: example ZFP
TSGELVR

SEQ ID NO: 3046 - protein, 7 aa, Artificial Sequence
  Description of Artificial Sequence: example ZFP
RADTLRR

SEQ ID NO: 3047 - protein, 7 aa, Artificial Sequence
  Description of Artificial Sequence: example ZFP
RSDVLQR

SEQ ID NO: 3048 - protein, 7 aa, Artificial Sequence
  Description of Artificial Sequence: example ZFP
RSDELQR

SEQ ID NO: 3049 - protein, 7 aa, Artificial Sequence
  Description of Artificial Sequence: example ZFP
RSDVLQR

SEQ ID NO: 3050 - protein, 7 aa, Artificial Sequence
  Description of Artificial Sequence: example ZFP
RSDELQR

SEQ ID NO: 3051 - protein, 7 aa, Artificial Sequence
  Description of Artificial Sequence: example ZFP
RSDDLQR

SEQ ID NO: 3052 - protein, 7 aa, Artificial Sequence
  Description of Artificial Sequence: example ZFP
RSDELQR

SEQ ID NO: 3053 - protein, 7 aa, Artificial Sequence
  Description of Artificial Sequence: example ZFP
RSDELQR

SEQ ID NO: 3054 - protein, 7 aa, Artificial Sequence
  Description of Artificial Sequence: example ZFP
RSDNLSR

SEQ ID NO: 3055 - protein, 7 aa, Artificial Sequence
  Description of Artificial Sequence: example ZFP
RSDNLSR

SEQ ID NO: 3056 - protein, 7 aa, Artificial Sequence
  Description of Artificial Sequence: example ZFP
DRSSLTR

SEQ ID NO: 3057 - protein, 7 aa, Artificial Sequence
  Description of Artificial Sequence: example ZFP
DRSDLTR

SEQ ID NO: 3058 - protein, 7 aa, Artificial Sequence
  Description of Artificial Sequence: example ZFP
DRSHLAR

SEQ ID NO: 3059 - protein, 7 aa, Artificial Sequence
  Description of Artificial Sequence: example ZFP
DRSHLAR

SEQ ID NO: 3060 - protein, 7 aa, Artificial Sequence
  Description of Artificial Sequence: example ZFP
DRSHLAR

SEQ ID NO: 3061 - protein, 7 aa, Artificial Sequence
  Description of Artificial Sequence: example ZFP
RSDELQR

SEQ ID NO: 3062 - protein, 7 aa, Artificial Sequence
  Description of Artificial Sequence: example ZFP
RSDELQR

SEQ ID NO: 3063 - protein, 7 aa, Artificial Sequence
  Description of Artificial Sequence: example ZFP
DRSSLTR

SEQ ID NO: 3064 - protein, 7 aa, Artificial Sequence
  Description of Artificial Sequence: example ZFP
DRSDLTR

SEQ ID NO: 3065 - protein, 7 aa, Artificial Sequence
  Description of Artificial Sequence: example ZFP
QSGSLTR

SEQ ID NO: 3066 - protein, 7 aa, Artificial Sequence
  Description of Artificial Sequence: example ZFP
QSGDLTR

SEQ ID NO: 3067 - protein, 7 aa, Artificial Sequence
  Description of Artificial Sequence: example ZFP
RSDELQR

SEQ ID NO: 3068 - protein, 7 aa, Artificial Sequence
  Description of Artificial Sequence: example ZFP
RSDELQR

SEQ ID NO: 3069 - protein, 7 aa, Artificial Sequence
  Description of Artificial Sequence: example ZFP
RSDELQR

SEQ ID NO: 3070 - protein, 7 aa, Artificial Sequence
  Description of Artificial Sequence: example ZFP
DRSHLAR

SEQ ID NO: 3071 - protein, 7 aa, Artificial Sequence
  Description of Artificial Sequence: example ZFP
DRSHLAR

SEQ ID NO: 3072 - protein, 7 aa, Artificial Sequence
  Description of Artificial Sequence: example ZFP
DRSHLAR

SEQ ID NO: 3073 - protein, 7 aa, Artificial Sequence
  Description of Artificial Sequence: example ZFP
DRSHLAR

SEQ ID NO: 3074 - protein, 7 aa, Artificial Sequence
  Description of Artificial Sequence: example ZFP
QSSDLQR

SEQ ID NO: 3075 - protein, 7 aa, Artificial Sequence
  Description of Artificial Sequence: example ZFP
QSSDLQR

SEQ ID NO: 3076 - protein, 7 aa, Artificial Sequence
  Description of Artificial Sequence: example ZFP
QSSDLQR

SEQ ID NO: 3077 - protein, 7 aa, Artificial Sequence
  Description of Artificial Sequence: example ZFP
RSDNLAR

SEQ ID NO: 3078 - protein, 7 aa, Artificial Sequence
  Description of Artificial Sequence: example ZFP
RSDSLAR

SEQ ID NO: 3079 - protein, 7 aa, Artificial Sequence
  Description of Artificial Sequence: example ZFP
SSGSLVR

SEQ ID NO: 3080 - protein, 7 aa, Artificial Sequence
  Description of Artificial Sequence: example ZFP
TSGELVR

SEQ ID NO: 3081 - protein, 7 aa, Artificial Sequence
  Description of Artificial Sequence: example ZFP
DRSHLAR

SEQ ID NO: 3082 - protein, 7 aa, Artificial Sequence
  Description of Artificial Sequence: example ZFP
RSDNLAR

SEQ ID NO: 3083 - protein, 7 aa, Artificial Sequence
  Description of Artificial Sequence: example ZFP
RSDALTS

SEQ ID NO: 3084 - protein, 7 aa, Artificial Sequence
  Description of Artificial Sequence: example ZFP
RSDNLAR

SEQ ID NO: 3085 - protein, 7 aa, Artificial Sequence
  Description of Artificial Sequence: example ZFP
RSDNLTK

SEQ ID NO: 3086 - protein, 7 aa, Artificial Sequence
  Description of Artificial Sequence: example ZFP
RSDNLAR

SEQ ID NO: 3087 - protein, 7 aa, Artificial Sequence
  Description of Artificial Sequence: example ZFP
RSDALTR

SEQ ID NO: 3088 - protein, 7 aa, Artificial Sequence
  Description of Artificial Sequence: example ZFP
QSSDLSR

SEQ ID NO: 3089 - protein, 7 aa, Artificial Sequence
  Description of Artificial Sequence: example ZFP
RSDNLAR

SEQ ID NO: 3090 - protein, 7 aa, Artificial Sequence
  Description of Artificial Sequence: example ZFP
RSDNLTK

SEQ ID NO: 3091 - protein, 7 aa, Artificial Sequence
  Description of Artificial Sequence: example ZFP
RSDNLTK

SEQ ID NO: 3092 - protein, 7 aa, Artificial Sequence
  Description of Artificial Sequence: example ZFP
RSDHLTR

SEQ ID NO: 3093 - protein, 7 aa, Artificial Sequence
  Description of Artificial Sequence: example ZFP
QSGHLTR

SEQ ID NO: 3094 - protein, 7 aa, Artificial Sequence
  Description of Artificial Sequence: example ZFP
RSDSLTQ

SEQ ID NO: 3095 - protein, 7 aa, Artificial Sequence
  Description of Artificial Sequence: example ZFP
RSDSLTQ

SEQ ID NO: 3096 - protein, 7 aa, Artificial Sequence
  Description of Artificial Sequence: example ZFP
QSGHLTR

SEQ ID NO: 3097 - protein, 7 aa, Artificial Sequence
  Description of Artificial Sequence: example ZFP
RSDSLAR

SEQ ID NO: 3098 - protein, 7 aa, Artificial Sequence
  Description of Artificial Sequence: example ZFP
QSSSLVR

SEQ ID NO: 3099 - protein, 7 aa, Artificial Sequence
  Description of Artificial Sequence: example ZFP
QSGHLNQ

SEQ ID NO: 3100 - protein, 7 aa, Artificial Sequence
  Description of Artificial Sequence: example ZFP
QSGSLTR

SEQ ID NO: 3101 - protein, 7 aa, Artificial Sequence
  Description of Artificial Sequence: example ZFP
RSDNLAR

SEQ ID NO: 3102 - protein, 7 aa, Artificial Sequence
  Description of Artificial Sequence: example ZFP
RSDSLTK

SEQ ID NO: 3103 - protein, 7 aa, Artificial Sequence
  Description of Artificial Sequence: example ZFP
TSGNLVR

SEQ ID NO: 3104 - protein, 7 aa, Artificial Sequence
  Description of Artificial Sequence: example ZFP
QSSSLVR

SEQ ID NO: 3105 - protein, 7 aa, Artificial Sequence
  Description of Artificial Sequence: example ZFP
RSDNLAR

SEQ ID NO: 3106 - protein, 7 aa, Artificial Sequence
  Description of Artificial Sequence: example ZFP
RSDNLTK

SEQ ID NO: 3107 - protein, 7 aa, Artificial Sequence
  Description of Artificial Sequence: example ZFP
RSDNLAR

SEQ ID NO: 3108 - protein, 7 aa, Artificial Sequence
  Description of Artificial Sequence: example ZFP
RSDNLAR

SEQ ID NO: 3109 - protein, 7 aa, Artificial Sequence
  Description of Artificial Sequence: example ZFP
QSSSLVR

SEQ ID NO: 3110 - protein, 7 aa, Artificial Sequence
  Description of Artificial Sequence: example ZFP
QSSDLSR

SEQ ID NO: 3111 - protein, 7 aa, Artificial Sequence
  Description of Artificial Sequence: example ZFP
RSDELQR

SEQ ID NO: 3112 - protein, 7 aa, Artificial Sequence
  Description of Artificial Sequence: example ZFP
QSSDLQR

SEQ ID NO: 3113 - protein, 7 aa, Artificial Sequence
  Description of Artificial Sequence: example ZFP
DRSALTT

SEQ ID NO: 3114 - protein, 7 aa, Artificial Sequence
  Description of Artificial Sequence: example ZFP
DRSALTK

SEQ ID NO: 3115 - protein, 7 aa, Artificial Sequence
  Description of Artificial Sequence: example ZFP
DRSALRT

SEQ ID NO: 3116 - protein, 7 aa, Artificial Sequence
  Description of Artificial Sequence: example ZFP
RSDHLSR

SEQ ID NO: 3117 - protein, 7 aa, Artificial Sequence
  Description of Artificial Sequence: example ZFP
RSDHLSR

SEQ ID NO: 3118 - protein, 7 aa, Artificial Sequence
  Description of Artificial Sequence: example ZFP
TSGELVR

SEQ ID NO: 3119 - protein, 7 aa, Artificial Sequence
  Description of Artificial Sequence: example ZFP
QSSDLQR

SEQ ID NO: 3120 - protein, 7 aa, Artificial Sequence
  Description of Artificial Sequence: example ZFP
RSDNLRT

SEQ ID NO: 3121 - protein, 7 aa, Artificial Sequence
  Description of Artificial Sequence: example ZFP
QSGHLTR

SEQ ID NO: 3122 - protein, 7 aa, Artificial Sequence
  Description of Artificial Sequence: example ZFP
QRAHLER

SEQ ID NO: 3123 - protein, 7 aa, Artificial Sequence
  Description of Artificial Sequence: example ZFP
QSGSLTR

SEQ ID NO: 3124 - protein, 7 aa, Artificial Sequence
  Description of Artificial Sequence: example ZFP
QSGDLRR

SEQ ID NO: 3125 - protein, 7 aa, Artificial Sequence
  Description of Artificial Sequence: example ZFP
QSGSLTR

SEQ ID NO: 3126 - protein, 7 aa, Artificial Sequence
  Description of Artificial Sequence: example ZFP
QSSDLQR

SEQ ID NO: 3127 - protein, 7 aa, Artificial Sequence
  Description of Artificial Sequence: example ZFP
QSSDLQR

SEQ ID NO: 3128 - protein, 7 aa, Artificial Sequence
  Description of Artificial Sequence: example ZFP
QSSDLQR

SEQ ID NO: 3129 - protein, 7 aa, Artificial Sequence
  Description of Artificial Sequence: example ZFP
QSSDLQR

SEQ ID NO: 3130 - protein, 7 aa, Artificial Sequence
  Description of Artificial Sequence: example ZFP
EKANLTR

SEQ ID NO: 3131 - protein, 7 aa, Artificial Sequence
  Description of Artificial Sequence: example ZFP
DRSNLTR

SEQ ID NO: 3132 - protein, 7 aa, Artificial Sequence
  Description of Artificial Sequence: example ZFP
QSGSLTR

SEQ ID NO: 3133 - protein, 7 aa, Artificial Sequence
  Description of Artificial Sequence: example ZFP
QSGSLTR

SEQ ID NO: 3134 - protein, 7 aa, Artificial Sequence
  Description of Artificial Sequence: example ZFP
QSGSLTR

SEQ ID NO: 3135 - protein, 7 aa, Artificial Sequence
  Description of Artificial Sequence: example ZFP
QSGDLTR

SEQ ID NO: 3136 - protein, 7 aa, Artificial Sequence
  Description of Artificial Sequence: example ZFP
DRSSLTR

SEQ ID NO: 3137 - protein, 7 aa, Artificial Sequence
  Description of Artificial Sequence: example ZFP
DRSDLTR

SEQ ID NO: 3138 - protein, 7 aa, Artificial Sequence
  Description of Artificial Sequence: example ZFP
RSDNLAR

SEQ ID NO: 3139 - protein, 7 aa, Artificial Sequence
  Description of Artificial Sequence: example ZFP
RSDELQR

SEQ ID NO: 3140 - protein, 7 aa, Artificial Sequence
  Description of Artificial Sequence: example ZFP
RSDELQR

SEQ ID NO: 3141 - protein, 7 aa, Artificial Sequence
  Description of Artificial Sequence: example ZFP
RSDELQR

SEQ ID NO: 3142 - protein, 7 aa, Artificial Sequence
  Description of Artificial Sequence: example ZFP
QSGSLTR

SEQ ID NO: 3143 - protein, 7 aa, Artificial Sequence
  Description of Artificial Sequence: example ZFP
DRSHLAR

SEQ ID NO: 3144 - protein, 7 aa, Artificial Sequence
  Description of Artificial Sequence: example ZFP
DRSHLAR

SEQ ID NO: 3145 - protein, 7 aa, Artificial Sequence
  Description of Artificial Sequence: example ZFP
DRSHLAR

SEQ ID NO: 3146 - protein, 7 aa, Artificial Sequence
  Description of Artificial Sequence: example ZFP
RSDHLTR

SEQ ID NO: 3147 - protein, 7 aa, Artificial Sequence
  Description of Artificial Sequence: example ZFP
RSDHLTR

SEQ ID NO: 3148 - protein, 7 aa, Artificial Sequence
  Description of Artificial Sequence: example ZFP
QSGSLTR

SEQ ID NO: 3149 - protein, 7 aa, Artificial Sequence
  Description of Artificial Sequence: example ZFP
QSGDLTR

SEQ ID NO: 3150 - protein, 7 aa, Artificial Sequence
  Description of Artificial Sequence: example ZFP
RSDALTT

SEQ ID NO: 3151 - protein, 7 aa, Artificial Sequence
  Description of Artificial Sequence: example ZFP
RSDALTK

SEQ ID NO: 3152 - protein, 7 aa, Artificial Sequence
  Description of Artificial Sequence: example ZFP
RSDALTK

SEQ ID NO: 3153 - protein, 7 aa, Artificial Sequence
  Description of Artificial Sequence: example ZFP
QSGSLTR

SEQ ID NO: 3154 - protein, 7 aa, Artificial Sequence
  Description of Artificial Sequence: example ZFP
QSGDLRR

SEQ ID NO: 3155 - protein, 7 aa, Artificial Sequence
  Description of Artificial Sequence: example ZFP
RSDHLSR

SEQ ID NO: 3156 - protein, 7 aa, Artificial Sequence
  Description of Artificial Sequence: example ZFP
RSDHLSR

SEQ ID NO: 3157 - protein, 7 aa, Artificial Sequence
  Description of Artificial Sequence: example ZFP
RSDNLAR

SEQ ID NO: 3158 - protein, 7 aa, Artificial Sequence
  Description of Artificial Sequence: example ZFP
RSDNLTR

SEQ ID NO: 3159 - protein, 7 aa, Artificial Sequence
  Description of Artificial Sequence: example ZFP
RSDELTR

SEQ ID NO: 3160 - protein, 7 aa, Artificial Sequence
  Description of Artificial Sequence: example ZFP
RSDALSR

SEQ ID NO: 3161 - protein, 7 aa, Artificial Sequence
  Description of Artificial Sequence: example ZFP
RSDNLAR

SEQ ID NO: 3162 - protein, 7 aa, Artificial Sequence
  Description of Artificial Sequence: example ZFP
RSDNLAR

SEQ ID NO: 3163 - protein, 7 aa, Artificial Sequence
  Description of Artificial Sequence: example ZFP
QSSDLQR

SEQ ID NO: 3164 - protein, 7 aa, Artificial Sequence
  Description of Artificial Sequence: example ZFP
RSDELQR

SEQ ID NO: 3165 - protein, 7 aa, Artificial Sequence
  Description of Artificial Sequence: example ZFP
RSDELQR

SEQ ID NO: 3166 - protein, 7 aa, Artificial Sequence
  Description of Artificial Sequence: example ZFP
RSDNLAR

SEQ ID NO: 3167 - protein, 7 aa, Artificial Sequence
  Description of Artificial Sequence: example ZFP
RSDELQR

SEQ ID NO: 3168 - protein, 7 aa, Artificial Sequence
  Description of Artificial Sequence: example ZFP
RSDNLAR

SEQ ID NO: 3169 - protein, 7 aa, Artificial Sequence
  Description of Artificial Sequence: example ZFP
RGDALTS

SEQ ID NO: 3170 - protein, 7 aa, Artificial Sequence
  Description of Artificial Sequence: example ZFP
RSDNLAR

SEQ ID NO: 3171 - protein, 7 aa, Artificial Sequence
  Description of Artificial Sequence: example ZFP
QSSALTR

SEQ ID NO: 3172 - protein, 7 aa, Artificial Sequence
  Description of Artificial Sequence: example ZFP
QRAHLER

SEQ ID NO: 3173 - protein, 7 aa, Artificial Sequence
  Description of Artificial Sequence: example ZFP
QRAHLER

SEQ ID NO: 3174 - protein, 7 aa, Artificial Sequence
  Description of Artificial Sequence: example ZFP
DCRDLAR

SEQ ID NO: 3175 - protein, 7 aa, Artificial Sequence
  Description of Artificial Sequence: example ZFP
RSDHLTR

SEQ ID NO: 3176 - protein, 7 aa, Artificial Sequence
  Description of Artificial Sequence: example ZFP
TSGSLTR

SEQ ID NO: 3177 - protein, 7 aa, Artificial Sequence
  Description of Artificial Sequence: example ZFP
RGDALTS

SEQ ID NO: 3178 - protein, 7 aa, Artificial Sequence
  Description of Artificial Sequence: example ZFP
QRAHLER

SEQ ID NO: 3179 - protein, 7 aa, Artificial Sequence
  Description of Artificial Sequence: example ZFP
QSGSLTR

SEQ ID NO: 3180 - protein, 7 aa, Artificial Sequence
  Description of Artificial Sequence: example ZFP
QSGDLTR

SEQ ID NO: 3181 - protein, 7 aa, Artificial Sequence
  Description of Artificial Sequence: example ZFP
QSGSLTR

SEQ ID NO: 3182 - protein, 7 aa, Artificial Sequence
  Description of Artificial Sequence: example ZFP
QSGDLTR

SEQ ID NO: 3183 - protein, 7 aa, Artificial Sequence
  Description of Artificial Sequence: example ZFP
QSGDLTR

SEQ ID NO: 3184 - protein, 7 aa, Artificial Sequence
  Description of Artificial Sequence: example ZFP
QRAHLER

SEQ ID NO: 3185 - protein, 7 aa, Artificial Sequence
  Description of Artificial Sequence: example ZFP
TSGELVR

SEQ ID NO: 3186 - protein, 7 aa, Artificial Sequence
  Description of Artificial Sequence: example ZFP
QRAHLER

SEQ ID NO: 3187 - protein, 7 aa, Artificial Sequence
  Description of Artificial Sequence: example ZFP
QRAHLER

SEQ ID NO: 3188 - protein, 7 aa, Artificial Sequence
  Description of Artificial Sequence: example ZFP
QSSSLVR

SEQ ID NO: 3189 - protein, 7 aa, Artificial Sequence
  Description of Artificial Sequence: example ZFP
QSATLAR

SEQ ID NO: 3190 - protein, 7 aa, Artificial Sequence
  Description of Artificial Sequence: example ZFP
RSDHLTR

SEQ ID NO: 3191 - protein, 7 aa, Artificial Sequence
  Description of Artificial Sequence: example ZFP
TSGSLTR

SEQ ID NO: 3192 - protein, 7 aa, Artificial Sequence
  Description of Artificial Sequence: example ZFP
QSSALTR

SEQ ID NO: 3193 - protein, 7 aa, Artificial Sequence
  Description of Artificial Sequence: example ZFP
QSSNLVR

SEQ ID NO: 3194 - protein, 7 aa, Artificial Sequence
  Description of Artificial Sequence: example ZFP
RSDELTR

SEQ ID NO: 3195 - protein, 7 aa, Artificial Sequence
  Description of Artificial Sequence: example ZFP
QRAHLER

SEQ ID NO: 3196 - protein, 7 aa, Artificial Sequence
  Description of Artificial Sequence: example ZFP
RSDNLAR

SEQ ID NO: 3197 - protein, 7 aa, Artificial Sequence
  Description of Artificial Sequence: example ZFP
DRSNLTR

SEQ ID NO: 3198 - protein, 7 aa, Artificial Sequence
  Description of Artificial Sequence: example ZFP
RSDALTR

SEQ ID NO: 3199 - protein, 7 aa, Artificial Sequence
  Description of Artificial Sequence: example ZFP
RSDALTR

SEQ ID NO: 3200 - protein, 7 aa, Artificial Sequence
  Description of Artificial Sequence: example ZFP
QSGNLAR

SEQ ID NO: 3201 - protein, 7 aa, Artificial Sequence
  Description of Artificial Sequence: example ZFP
TSGNLVR

SEQ ID NO: 3202 - protein, 7 aa, Artificial Sequence
  Description of Artificial Sequence: example ZFP
TSGELVR

SEQ ID NO: 3203 - protein, 7 aa, Artificial Sequence
  Description of Artificial Sequence: example ZFP
RSDHLTR

SEQ ID NO: 3204 - protein, 7 aa, Artificial Sequence
  Description of Artificial Sequence: example ZFP
DPGALVR

SEQ ID NO: 3205 - protein, 7 aa, Artificial Sequence
  Description of Artificial Sequence: example ZFP
QSGDLTR

SEQ ID NO: 3206 - protein, 7 aa, Artificial Sequence
  Description of Artificial Sequence: example ZFP
QRAHLER

SEQ ID NO: 3207 - protein, 7 aa, Artificial Sequence
  Description of Artificial Sequence: example ZFP
TSGELVR

SEQ ID NO: 3208 - protein, 7 aa, Artificial Sequence
  Description of Artificial Sequence: example ZFP
TSGELVR

SEQ ID NO: 3209 - protein, 7 aa, Artificial Sequence
  Description of Artificial Sequence: example ZFP
RSDHLTR

SEQ ID NO: 3210 - protein, 7 aa, Artificial Sequence
  Description of Artificial Sequence: example ZFP
RSDELQR

SEQ ID NO: 3211 - protein, 7 aa, Artificial Sequence
  Description of Artificial Sequence: example ZFP
QRAHLER

SEQ ID NO: 3212 - protein, 7 aa, Artificial Sequence
  Description of Artificial Sequence: example ZFP
QRAHLER

SEQ ID NO: 3213 - protein, 7 aa, Artificial Sequence
  Description of Artificial Sequence: example ZFP
RSDHLTR

SEQ ID NO: 3214 - protein, 7 aa, Artificial Sequence
  Description of Artificial Sequence: example ZFP
DRSDLTR

SEQ ID NO: 3215 - protein, 7 aa, Artificial Sequence
  Description of Artificial Sequence: example ZFP
QSSHLAR

SEQ ID NO: 3216 - protein, 7 aa, Artificial Sequence
  Description of Artificial Sequence: example ZFP
DRSNLTR

SEQ ID NO: 3217 - protein, 7 aa, Artificial Sequence
  Description of Artificial Sequence: example ZFP
RSDNLTR

SEQ ID NO: 3218 - protein, 7 aa, Artificial Sequence
  Description of Artificial Sequence: example ZFP
RSDNLTR

SEQ ID NO: 3219 - protein, 7 aa, Artificial Sequence
  Description of Artificial Sequence: example ZFP
RSDNLTR

SEQ ID NO: 3220 - protein, 7 aa, Artificial Sequence
  Description of Artificial Sequence: example ZFP
QRSALAR

SEQ ID NO: 3221 - protein, 7 aa, Artificial Sequence
  Description of Artificial Sequence: example ZFP
TSGELVR

SEQ ID NO: 3222 - protein, 7 aa, Artificial Sequence
  Description of Artificial Sequence: example ZFP
TSGELVR

SEQ ID NO: 3223 - protein, 7 aa, Artificial Sequence
  Description of Artificial Sequence: example ZFP
RSDELQR

SEQ ID NO: 3224 - protein, 7 aa, Artificial Sequence
  Description of Artificial Sequence: example ZFP
QSSALTR

SEQ ID NO: 3225 - protein, 7 aa, Artificial Sequence
  Description of Artificial Sequence: example ZFP
TSGSLTR

SEQ ID NO: 3226 - protein, 7 aa, Artificial Sequence
  Description of Artificial Sequence: example ZFP
QSGHLTR

SEQ ID NO: 3227 - protein, 7 aa, Artificial Sequence
  Description of Artificial Sequence: example ZFP
QRAHLER

SEQ ID NO: 3228 - protein, 7 aa, Artificial Sequence
  Description of Artificial Sequence: example ZFP
QSSNLVR

SEQ ID NO: 3229 - protein, 7 aa, Artificial Sequence
  Description of Artificial Sequence: example ZFP
DRSDLTR

SEQ ID NO: 3230 - protein, 7 aa, Artificial Sequence
  Description of Artificial Sequence: example ZFP
RADALMV

SEQ ID NO: 3231 - protein, 7 aa, Artificial Sequence
  Description of Artificial Sequence: example ZFP
QSGHLTT

SEQ ID NO: 3232 - protein, 7 aa, Artificial Sequence
  Description of Artificial Sequence: example ZFP
QSVHLQS

SEQ ID NO: 3233 - protein, 7 aa, Artificial Sequence
  Description of Artificial Sequence: example ZFP
RSDNLTQ

SEQ ID NO: 3234 - protein, 7 aa, Artificial Sequence
  Description of Artificial Sequence: example ZFP
RSDNLTQ

SEQ ID NO: 3235 - protein, 7 aa, Artificial Sequence
  Description of Artificial Sequence: example ZFP
RSDNLTQ

SEQ ID NO: 3236 - protein, 7 aa, Artificial Sequence
  Description of Artificial Sequence: example ZFP
RSSDLTR

SEQ ID NO: 3237 - protein, 7 aa, Artificial Sequence
  Description of Artificial Sequence: example ZFP
RSDNLAR

SEQ ID NO: 3238 - protein, 7 aa, Artificial Sequence
  Description of Artificial Sequence: example ZFP
RADALMV

SEQ ID NO: 3239 - protein, 7 aa, Artificial Sequence
  Description of Artificial Sequence: example ZFP
RSDNLAR

SEQ ID NO: 3240 - protein, 7 aa, Artificial Sequence
  Description of Artificial Sequence: example ZFP
RSDHLTR

SEQ ID NO: 3241 - protein, 7 aa, Artificial Sequence
  Description of Artificial Sequence: example ZFP
QSGNLAR

SEQ ID NO: 3242 - protein, 7 aa, Artificial Sequence
  Description of Artificial Sequence: example ZFP
QSSNLVR

SEQ ID NO: 3243 - protein, 7 aa, Artificial Sequence
  Description of Artificial Sequence: example ZFP
DPGALVR

SEQ ID NO: 3244 - protein, 7 aa, Artificial Sequence
  Description of Artificial Sequence: example ZFP
QRAHLER

SEQ ID NO: 3245 - protein, 7 aa, Artificial Sequence
  Description of Artificial Sequence: example ZFP
DRSHLAR

SEQ ID NO: 3246 - protein, 7 aa, Artificial Sequence
  Description of Artificial Sequence: example ZFP
TSGNLVR

SEQ ID NO: 3247 - protein, 7 aa, Artificial Sequence
  Description of Artificial Sequence: example ZFP
RSSDLTR

SEQ ID NO: 3248 - protein, 7 aa, Artificial Sequence
  Description of Artificial Sequence: example ZFP
QSGNLAR

SEQ ID NO: 3249 - protein, 7 aa, Artificial Sequence
  Description of Artificial Sequence: example ZFP
TSGELVR

SEQ ID NO: 3250 - protein, 7 aa, Artificial Sequence
  Description of Artificial Sequence: example ZFP
QSGNLAR

SEQ ID NO: 3251 - protein, 7 aa, Artificial Sequence
  Description of Artificial Sequence: example ZFP
QSSNLVR

SEQ ID NO: 3252 - protein, 7 aa, Artificial Sequence
  Description of Artificial Sequence: example ZFP
QSGNLAR

SEQ ID NO: 3253 - protein, 7 aa, Artificial Sequence
  Description of Artificial Sequence: example ZFP
QSHNLAR

SEQ ID NO: 3254 - protein, 7 aa, Artificial Sequence
  Description of Artificial Sequence: example ZFP
RSKNLQR

SEQ ID NO: 3255 - protein, 7 aa, Artificial Sequence
  Description of Artificial Sequence: example ZFP
RSDALTR

SEQ ID NO: 3256 - protein, 7 aa, Artificial Sequence
  Description of Artificial Sequence: example ZFP
QSSSLVR

SEQ ID NO: 3257 - protein, 7 aa, Artificial Sequence
  Description of Artificial Sequence: example ZFP
TSGALTR

SEQ ID NO: 3258 - protein, 7 aa, Artificial Sequence
  Description of Artificial Sequence: example ZFP
QSGDLTR

SEQ ID NO: 3259 - protein, 7 aa, Artificial Sequence
  Description of Artificial Sequence: example ZFP
QSGSLTR

SEQ ID NO: 3260 - protein, 7 aa, Artificial Sequence
  Description of Artificial Sequence: example ZFP
QSGDLTR

SEQ ID NO: 3261 - protein, 7 aa, Artificial Sequence
  Description of Artificial Sequence: example ZFP
QSGSLTR

SEQ ID NO: 3262 - protein, 7 aa, Artificial Sequence
  Description of Artificial Sequence: example ZFP
RSDNRTA

SEQ ID NO: 3263 - protein, 7 aa, Artificial Sequence
  Description of Artificial Sequence: example ZFP
RSDNRTA

SEQ ID NO: 3264 - protein, 7 aa, Artificial Sequence
  Description of Artificial Sequence: example ZFP
MSHHLSR

SEQ ID NO: 3265 - protein, 7 aa, Artificial Sequence
  Description of Artificial Sequence: example ZFP
RSDNLTR

SEQ ID NO: 3266 - protein, 7 aa, Artificial Sequence
  Description of Artificial Sequence: example ZFP
RSSNLTR

SEQ ID NO: 3267 - protein, 7 aa, Artificial Sequence
  Description of Artificial Sequence: example ZFP
RSHNLTR

SEQ ID NO: 3268 - protein, 7 aa, Artificial Sequence
  Description of Artificial Sequence: example ZFP
RSDNLTR

SEQ ID NO: 3269 - protein, 7 aa, Artificial Sequence
  Description of Artificial Sequence: example ZFP
QRSALAR

SEQ ID NO: 3270 - protein, 7 aa, Artificial Sequence
  Description of Artificial Sequence: example ZFP
QSSSLVR

SEQ ID NO: 3271 - protein, 7 aa, Artificial Sequence
  Description of Artificial Sequence: example ZFP
QSGDLTR

SEQ ID NO: 3272 - protein, 7 aa, Artificial Sequence
  Description of Artificial Sequence: example ZFP
QRAHLER

SEQ ID NO: 3273 - protein, 7 aa, Artificial Sequence
  Description of Artificial Sequence: example ZFP
TSGELVR

SEQ ID NO: 3274 - protein, 7 aa, Artificial Sequence
  Description of Artificial Sequence: example ZFP
QSSNLVR

SEQ ID NO: 3275 - protein, 7 aa, Artificial Sequence
  Description of Artificial Sequence: example ZFP
RSDELTR

SEQ ID NO: 3276 - protein, 7 aa, Artificial Sequence
  Description of Artificial Sequence: example ZFP
RSDHLTR

SEQ ID NO: 3277 - protein, 7 aa, Artificial Sequence
  Description of Artificial Sequence: example ZFP
QSSNLVR

SEQ ID NO: 3278 - protein, 7 aa, Artificial Sequence
  Description of Artificial Sequence: example ZFP
QRAHLER

SEQ ID NO: 3279 - protein, 7 aa, Artificial Sequence
  Description of Artificial Sequence: example ZFP
RSDHLTR

SEQ ID NO: 3280 - protein, 7 aa, Artificial Sequence
  Description of Artificial Sequence: example ZFP
RSDNLTR

SEQ ID NO: 3281 - protein, 7 aa, Artificial Sequence
  Description of Artificial Sequence: example ZFP
RSQALTR

SEQ ID NO: 3282 - protein, 7 aa, Artificial Sequence
  Description of Artificial Sequence: example ZFP
QSHNLAR

SEQ ID NO: 3283 - protein, 7 aa, Artificial Sequence
  Description of Artificial Sequence: example ZFP
QSGNLAR

SEQ ID NO: 3284 - protein, 7 aa, Artificial Sequence
  Description of Artificial Sequence: example ZFP
QSSNLVR

SEQ ID NO: 3285 - protein, 7 aa, Artificial Sequence
  Description of Artificial Sequence: example ZFP
RSDNLAR

SEQ ID NO: 3286 - protein, 7 aa, Artificial Sequence
  Description of Artificial Sequence: example ZFP
DRSNLTR

SEQ ID NO: 3287 - protein, 7 aa, Artificial Sequence
  Description of Artificial Sequence: example ZFP
DRSNLTR

SEQ ID NO: 3288 - protein, 7 aa, Artificial Sequence
  Description of Artificial Sequence: example ZFP
RSDHLTK

SEQ ID NO: 3289 - protein, 7 aa, Artificial Sequence
  Description of Artificial Sequence: example ZFP
DRSDLTR

SEQ ID NO: 3290 - protein, 7 aa, Artificial Sequence
  Description of Artificial Sequence: example ZFP
MSHHLSR

SEQ ID NO: 3291 - protein, 7 aa, Artificial Sequence
  Description of Artificial Sequence: example ZFP
QSGHLTR

SEQ ID NO: 3292 - protein, 7 aa, Artificial Sequence
  Description of Artificial Sequence: example ZFP
QRAHLER

SEQ ID NO: 3293 - protein, 7 aa, Artificial Sequence
  Description of Artificial Sequence: example ZFP
DRSNLTR

SEQ ID NO: 3294 - protein, 7 aa, Artificial Sequence
  Description of Artificial Sequence: example ZFP
DRSNLTR

SEQ ID NO: 3295 - protein, 7 aa, Artificial Sequence
  Description of Artificial Sequence: example ZFP
RSDNLTK

SEQ ID NO: 3296 - protein, 7 aa, Artificial Sequence
  Description of Artificial Sequence: example ZFP
RSDHLTT

SEQ ID NO: 3297 - protein, 7 aa, Artificial Sequence
  Description of Artificial Sequence: example ZFP
QRAHLER

SEQ ID NO: 3298 - protein, 7 aa, Artificial Sequence
  Description of Artificial Sequence: example ZFP
TSGNLVR

SEQ ID NO: 3299 - protein, 7 aa, Artificial Sequence
  Description of Artificial Sequence: example ZFP
DPGNLVR

SEQ ID NO: 3300 - protein, 7 aa, Artificial Sequence
  Description of Artificial Sequence: example ZFP
RSDNLTR

SEQ ID NO: 3301 - protein, 7 aa, Artificial Sequence
  Description of Artificial Sequence: example ZFP
RSDALAR

SEQ ID NO: 3302 - protein, 7 aa, Artificial Sequence
  Description of Artificial Sequence: example ZFP
TSGSLTR

SEQ ID NO: 3303 - protein, 7 aa, Artificial Sequence
  Description of Artificial Sequence: example ZFP
QSSALTR

SEQ ID NO: 3304 - protein, 7 aa, Artificial Sequence
  Description of Artificial Sequence: example ZFP
RSDELQR

SEQ ID NO: 3305 - protein, 7 aa, Artificial Sequence
  Description of Artificial Sequence: example ZFP
RSDELQR

SEQ ID NO: 3306 - protein, 7 aa, Artificial Sequence
  Description of Artificial Sequence: example ZFP
TSGSLTR

SEQ ID NO: 3307 - protein, 7 aa, Artificial Sequence
  Description of Artificial Sequence: example ZFP
TSGALTR

SEQ ID NO: 3308 - protein, 7 aa, Artificial Sequence
  Description of Artificial Sequence: example ZFP
RSDNLTT

SEQ ID NO: 3309 - protein, 7 aa, Artificial Sequence
  Description of Artificial Sequence: example ZFP
QSGHLTR

SEQ ID NO: 3310 - protein, 7 aa, Artificial Sequence
  Description of Artificial Sequence: example ZFP
QSGHLTR

SEQ ID NO: 3311 - protein, 7 aa, Artificial Sequence
  Description of Artificial Sequence: example ZFP
QSSDLTR

SEQ ID NO: 3312 - protein, 7 aa, Artificial Sequence
  Description of Artificial Sequence: example ZFP
QRAHLER

SEQ ID NO: 3313 - protein, 7 aa, Artificial Sequence
  Description of Artificial Sequence: example ZFP
RSDNLTK

SEQ ID NO: 3314 - protein, 7 aa, Artificial Sequence
  Description of Artificial Sequence: example ZFP
RSDNLQR

SEQ ID NO: 3315 - protein, 7 aa, Artificial Sequence
  Description of Artificial Sequence: example ZFP
RSDNLQR

SEQ ID NO: 3316 - protein, 7 aa, Artificial Sequence
  Description of Artificial Sequence: example ZFP
RSDNLQR

SEQ ID NO: 3317 - protein, 7 aa, Artificial Sequence
  Description of Artificial Sequence: example ZFP
DRDHLTR

SEQ ID NO: 3318 - protein, 7 aa, Artificial Sequence
  Description of Artificial Sequence: example ZFP
DRDHLTR

SEQ ID NO: 3319 - protein, 7 aa, Artificial Sequence
  Description of Artificial Sequence: example ZFP
RSDHLTR

SEQ ID NO: 3320 - protein, 7 aa, Artificial Sequence
  Description of Artificial Sequence: example ZFP
RSDHLTR

SEQ ID NO: 3321 - protein, 7 aa, Artificial Sequence
  Description of Artificial Sequence: example ZFP
RSDHLTR

SEQ ID NO: 3322 - protein, 7 aa, Artificial Sequence
  Description of Artificial Sequence: example ZFP
RADALMV

SEQ ID NO: 3323 - protein, 7 aa, Artificial Sequence
  Description of Artificial Sequence: example ZFP
RSDALTT

SEQ ID NO: 3324 - protein, 7 aa, Artificial Sequence
  Description of Artificial Sequence: example ZFP
QSSHLAR

SEQ ID NO: 3325 - protein, 7 aa, Artificial Sequence
  Description of Artificial Sequence: example ZFP
QSGSLTR

SEQ ID NO: 3326 - protein, 7 aa, Artificial Sequence
  Description of Artificial Sequence: example ZFP
RADALMV

SEQ ID NO: 3327 - protein, 7 aa, Artificial Sequence
  Description of Artificial Sequence: example ZFP
RSDALTT

SEQ ID NO: 3328 - protein, 7 aa, Artificial Sequence
  Description of Artificial Sequence: example ZFP
TSGNLVR

SEQ ID NO: 3329 - protein, 7 aa, Artificial Sequence
  Description of Artificial Sequence: example ZFP
QSGSLTR

SEQ ID NO: 3330 - protein, 7 aa, Artificial Sequence
  Description of Artificial Sequence: example ZFP
RSDNLAR

SEQ ID NO: 3331 - protein, 7 aa, Artificial Sequence
  Description of Artificial Sequence: example ZFP
RSDNLAR

SEQ ID NO: 3332 - protein, 7 aa, Artificial Sequence
  Description of Artificial Sequence: example ZFP
RSDHLTT

SEQ ID NO: 3333 - protein, 7 aa, Artificial Sequence
  Description of Artificial Sequence: example ZFP
RSDHLTT

SEQ ID NO: 3334 - protein, 7 aa, Artificial Sequence
  Description of Artificial Sequence: example ZFP
QRSNLVR

SEQ ID NO: 3335 - protein, 7 aa, Artificial Sequence
  Description of Artificial Sequence: example ZFP
RSDNLAR

SEQ ID NO: 3336 - protein, 7 aa, Artificial Sequence
  Description of Artificial Sequence: example ZFP
RSDNLRT

SEQ ID NO: 3337 - protein, 7 aa, Artificial Sequence
  Description of Artificial Sequence: example ZFP
RSDALAR

SEQ ID NO: 3338 - protein, 7 aa, Artificial Sequence
  Description of Artificial Sequence: example ZFP
DPGALVR

SEQ ID NO: 3339 - protein, 7 aa, Artificial Sequence
  Description of Artificial Sequence: example ZFP
QSGALAR

SEQ ID NO: 3340 - protein, 7 aa, Artificial Sequence
  Description of Artificial Sequence: example ZFP
QSSHLAR

SEQ ID NO: 3341 - protein, 7 aa, Artificial Sequence
  Description of Artificial Sequence: example ZFP
QSGSLTR

SEQ ID NO: 3342 - protein, 7 aa, Artificial Sequence
  Description of Artificial Sequence: example ZFP
RSHALTR

SEQ ID NO: 3343 - protein, 7 aa, Artificial Sequence
  Description of Artificial Sequence: example ZFP
RSHALTR

SEQ ID NO: 3344 - protein, 7 aa, Artificial Sequence
  Description of Artificial Sequence: example ZFP
TSGNLVR

SEQ ID NO: 3345 - protein, 7 aa, Artificial Sequence
  Description of Artificial Sequence: example ZFP
QSGALAR

SEQ ID NO: 3346 - protein, 7 aa, Artificial Sequence
  Description of Artificial Sequence: example ZFP
QSGALAR

SEQ ID NO: 3347 - protein, 7 aa, Artificial Sequence
  Description of Artificial Sequence: example ZFP
RSDNLAR

SEQ ID NO: 3348 - protein, 7 aa, Artificial Sequence
  Description of Artificial Sequence: example ZFP
RSDNLAR

SEQ ID NO: 3349 - protein, 7 aa, Artificial Sequence
  Description of Artificial Sequence: example ZFP
QRSNLVR

SEQ ID NO: 3350 - protein, 7 aa, Artificial Sequence
  Description of Artificial Sequence: example ZFP
DPGNLVR

SEQ ID NO: 3351 - protein, 7 aa, Artificial Sequence
  Description of Artificial Sequence: example ZFP
RSDNLTK

SEQ ID NO: 3352 - protein, 7 aa, Artificial Sequence
  Description of Artificial Sequence: example ZFP
QSSDLTR

SEQ ID NO: 3353 - protein, 7 aa, Artificial Sequence
  Description of Artificial Sequence: example ZFP
RSDNLAR

SEQ ID NO: 3354 - protein, 7 aa, Artificial Sequence
  Description of Artificial Sequence: example ZFP
DCRDLAR

SEQ ID NO: 3355 - protein, 7 aa, Artificial Sequence
  Description of Artificial Sequence: example ZFP
QSGSLTR

SEQ ID NO: 3356 - protein, 7 aa, Artificial Sequence
  Description of Artificial Sequence: example ZFP
RSDNLAR

SEQ ID NO: 3357 - protein, 7 aa, Artificial Sequence
  Description of Artificial Sequence: example ZFP
RSDNLAR

SEQ ID NO: 3358 - protein, 7 aa, Artificial Sequence
  Description of Artificial Sequence: example ZFP
QSGSLTR

SEQ ID NO: 3359 - protein, 7 aa, Artificial Sequence
  Description of Artificial Sequence: example ZFP
RSDELQR

SEQ ID NO: 3360 - protein, 7 aa, Artificial Sequence
  Description of Artificial Sequence: example ZFP
RSDELQR

SEQ ID NO: 3361 - protein, 7 aa, Artificial Sequence
  Description of Artificial Sequence: example ZFP
RSDNLRE

SEQ ID NO: 3362 - protein, 7 aa, Artificial Sequence
  Description of Artificial Sequence: example ZFP
RSDNLTE

SEQ ID NO: 3363 - protein, 7 aa, Artificial Sequence
  Description of Artificial Sequence: example ZFP
RSDALAR

SEQ ID NO: 3364 - protein, 7 aa, Artificial Sequence
  Description of Artificial Sequence: example ZFP
RSDALAR

SEQ ID NO: 3365 - protein, 7 aa, Artificial Sequence
  Description of Artificial Sequence: example ZFP
QRAHLER

SEQ ID NO: 3366 - protein, 7 aa, Artificial Sequence
  Description of Artificial Sequence: example ZFP
QRAHLER

SEQ ID NO: 3367 - protein, 7 aa, Artificial Sequence
  Description of Artificial Sequence: example ZFP
QSGHLTR

SEQ ID NO: 3368 - protein, 7 aa, Artificial Sequence
  Description of Artificial Sequence: example ZFP
QSGHLTR

SEQ ID NO: 3369 - protein, 7 aa, Artificial Sequence
  Description of Artificial Sequence: example ZFP
QSHHLTR

SEQ ID NO: 3370 - protein, 7 aa, Artificial Sequence
  Description of Artificial Sequence: example ZFP
TSGSLTR

SEQ ID NO: 3371 - protein, 7 aa, Artificial Sequence
  Description of Artificial Sequence: example ZFP
QSSALTR

SEQ ID NO: 3372 - protein, 7 aa, Artificial Sequence
  Description of Artificial Sequence: example ZFP
TSGSLTR

SEQ ID NO: 3373 - protein, 7 aa, Artificial Sequence
  Description of Artificial Sequence: example ZFP
QSSALTR

SEQ ID NO: 3374 - protein, 7 aa, Artificial Sequence
  Description of Artificial Sequence: example ZFP
DRSDLTR

SEQ ID NO: 3375 - protein, 7 aa, Artificial Sequence
  Description of Artificial Sequence: example ZFP
RSDALTR

SEQ ID NO: 3376 - protein, 7 aa, Artificial Sequence
  Description of Artificial Sequence: example ZFP
DCRDLAR

SEQ ID NO: 3377 - protein, 7 aa, Artificial Sequence
  Description of Artificial Sequence: example ZFP
RSSDLTR

SEQ ID NO: 3378 - protein, 7 aa, Artificial Sequence
  Description of Artificial Sequence: example ZFP
QSSDLTR

SEQ ID NO: 3379 - protein, 7 aa, Artificial Sequence
  Description of Artificial Sequence: example ZFP
QSSDLTR

SEQ ID NO: 3380 - protein, 7 aa, Artificial Sequence
  Description of Artificial Sequence: example ZFP
QSSDLTR

SEQ ID NO: 3381 - protein, 7 aa, Artificial Sequence
  Description of Artificial Sequence: example ZFP
RSDALTQ

SEQ ID NO: 3382 - protein, 7 aa, Artificial Sequence
  Description of Artificial Sequence: example ZFP
RSDSLTQ

SEQ ID NO: 3383 - protein, 7 aa, Artificial Sequence
  Description of Artificial Sequence: example ZFP
RSDALTQ

SEQ ID NO: 3384 - protein, 7 aa, Artificial Sequence
  Description of Artificial Sequence: example ZFP
RSDSLTQ

SEQ ID NO: 3385 - protein, 7 aa, Artificial Sequence
  Description of Artificial Sequence: example ZFP
RSSDLTR

SEQ ID NO: 3386 - protein, 7 aa, Artificial Sequence
  Description of Artificial Sequence: example ZFP
RTSTLTR

SEQ ID NO: 3387 - protein, 7 aa, Artificial Sequence
  Description of Artificial Sequence: example ZFP
DRSHLAR

SEQ ID NO: 3388 - protein, 7 aa, Artificial Sequence
  Description of Artificial Sequence: example ZFP
RSDALAR

SEQ ID NO: 3389 - protein, 7 aa, Artificial Sequence
  Description of Artificial Sequence: example ZFP
QSHHLTT

SEQ ID NO: 3390 - protein, 7 aa, Artificial Sequence
  Description of Artificial Sequence: example ZFP
QAATLTT

SEQ ID NO: 3391 - protein, 7 aa, Artificial Sequence
  Description of Artificial Sequence: example ZFP
QSGHLTT

SEQ ID NO: 3392 - protein, 7 aa, Artificial Sequence
  Description of Artificial Sequence: example ZFP
QSHDLTK

SEQ ID NO: 3393 - protein, 7 aa, Artificial Sequence
  Description of Artificial Sequence: example ZFP
RSDHLTT

SEQ ID NO: 3394 - protein, 7 aa, Artificial Sequence
  Description of Artificial Sequence: example ZFP
RSDELQR

SEQ ID NO: 3395 - protein, 7 aa, Artificial Sequence
  Description of Artificial Sequence: example ZFP
RSDELQR

SEQ ID NO: 3396 - protein, 7 aa, Artificial Sequence
  Description of Artificial Sequence: example ZFP
RSDALTT

SEQ ID NO: 3397 - protein, 7 aa, Artificial Sequence
  Description of Artificial Sequence: example ZFP
RADALMV

SEQ ID NO: 3398 - protein, 7 aa, Artificial Sequence
  Description of Artificial Sequence: example ZFP
RSDALTT

SEQ ID NO: 3399 - protein, 7 aa, Artificial Sequence
  Description of Artificial Sequence: example ZFP
RADALMV

SEQ ID NO: 3400 - protein, 7 aa, Artificial Sequence
  Description of Artificial Sequence: example ZFP
RADALMV

SEQ ID NO: 3401 - protein, 7 aa, Artificial Sequence
  Description of Artificial Sequence: example ZFP
QSGNLQR

SEQ ID NO: 3402 - protein, 7 aa, Artificial Sequence
  Description of Artificial Sequence: example ZFP
QSGNLQR

SEQ ID NO: 3403 - protein, 7 aa, Artificial Sequence
  Description of Artificial Sequence: example ZFP
QRSNLVR

SEQ ID NO: 3404 - protein, 7 aa, Artificial Sequence
  Description of Artificial Sequence: example ZFP
QSSHLAR

SEQ ID NO: 3405 - protein, 7 aa, Artificial Sequence
  Description of Artificial Sequence: example ZFP
QSSHLAR

SEQ ID NO: 3406 - protein, 7 aa, Artificial Sequence
  Description of Artificial Sequence: example ZFP
TSGHLVR

SEQ ID NO: 3407 - protein, 7 aa, Artificial Sequence
  Description of Artificial Sequence: example ZFP
TSGHLVR

SEQ ID NO: 3408 - protein, 7 aa, Artificial Sequence
  Description of Artificial Sequence: example ZFP
QRAHLER

SEQ ID NO: 3409 - protein, 7 aa, Artificial Sequence
  Description of Artificial Sequence: example ZFP
QSGHLTR

SEQ ID NO: 3410 - protein, 7 aa, Artificial Sequence
  Description of Artificial Sequence: example ZFP
RSDALSR

SEQ ID NO: 3411 - protein, 7 aa, Artificial Sequence
  Description of Artificial Sequence: example ZFP
RSDELQR

SEQ ID NO: 3412 - protein, 7 aa, Artificial Sequence
  Description of Artificial Sequence: example ZFP
RSDDLQR

SEQ ID NO: 3413 - protein, 7 aa, Artificial Sequence
  Description of Artificial Sequence: example ZFP
RSDERKR

SEQ ID NO: 3414 - protein, 7 aa, Artificial Sequence
  Description of Artificial Sequence: example ZFP
RSDELQR

SEQ ID NO: 3415 - protein, 7 aa, Artificial Sequence
  Description of Artificial Sequence: example ZFP
RSDDLQR

SEQ ID NO: 3416 - protein, 7 aa, Artificial Sequence
  Description of Artificial Sequence: example ZFP
RSDERKR

SEQ ID NO: 3417 - protein, 7 aa, Artificial Sequence
  Description of Artificial Sequence: example ZFP
DRSNLTR

SEQ ID NO: 3418 - protein, 7 aa, Artificial Sequence
  Description of Artificial Sequence: example ZFP
DPGNLVR

SEQ ID NO: 3419 - protein, 7 aa, Artificial Sequence
  Description of Artificial Sequence: example ZFP
DRSNLTR

SEQ ID NO: 3420 - protein, 7 aa, Artificial Sequence
  Description of Artificial Sequence: example ZFP
DPGNLVR

SEQ ID NO: 3421 - protein, 7 aa, Artificial Sequence
  Description of Artificial Sequence: example ZFP
RSDALSR

SEQ ID NO: 3422 - protein, 7 aa, Artificial Sequence
  Description of Artificial Sequence: example ZFP
QSGSLTR

SEQ ID NO: 3423 - protein, 7 aa, Artificial Sequence
  Description of Artificial Sequence: example ZFP
QSGSLTR

SEQ ID NO: 3424 - protein, 7 aa, Artificial Sequence
  Description of Artificial Sequence: example ZFP
DCRDLAR

SEQ ID NO: 3425 - protein, 7 aa, Artificial Sequence
  Description of Artificial Sequence: example ZFP
QSGNLAR

SEQ ID NO: 3426 - protein, 7 aa, Artificial Sequence
  Description of Artificial Sequence: example ZFP
QSGNLAR

SEQ ID NO: 3427 - protein, 7 aa, Artificial Sequence
  Description of Artificial Sequence: example ZFP
RSDNLAR

SEQ ID NO: 3428 - protein, 7 aa, Artificial Sequence
  Description of Artificial Sequence: example ZFP
RSDNLAR

SEQ ID NO: 3429 - protein, 7 aa, Artificial Sequence
  Description of Artificial Sequence: example ZFP
RSDNLAR

SEQ ID NO: 3430 - protein, 7 aa, Artificial Sequence
  Description of Artificial Sequence: example ZFP
RSDHLTT

SEQ ID NO: 3431 - protein, 7 aa, Artificial Sequence
  Description of Artificial Sequence: example ZFP
RSDNLAR

SEQ ID NO: 3432 - protein, 7 aa, Artificial Sequence
  Description of Artificial Sequence: example ZFP
QSSHLAR

SEQ ID NO: 3433 - protein, 7 aa, Artificial Sequence
  Description of Artificial Sequence: example ZFP
RADALMV

SEQ ID NO: 3434 - protein, 7 aa, Artificial Sequence
  Description of Artificial Sequence: example ZFP
RSDNLAR

SEQ ID NO: 3435 - protein, 7 aa, Artificial Sequence
  Description of Artificial Sequence: example ZFP
QSGSLTR

SEQ ID NO: 3436 - protein, 7 aa, Artificial Sequence
  Description of Artificial Sequence: example ZFP
QSGSLTR

SEQ ID NO: 3437 - protein, 7 aa, Artificial Sequence
  Description of Artificial Sequence: example ZFP
QSGDLTR

SEQ ID NO: 3438 - protein, 7 aa, Artificial Sequence
  Description of Artificial Sequence: example ZFP
RSDELTR

SEQ ID NO: 3439 - protein, 7 aa, Artificial Sequence
  Description of Artificial Sequence: example ZFP
DRSHLAR

SEQ ID NO: 3440 - protein, 7 aa, Artificial Sequence
  Description of Artificial Sequence: example ZFP
QSGSLTR

SEQ ID NO: 3441 - protein, 7 aa, Artificial Sequence
  Description of Artificial Sequence: example ZFP
QSGSLTR

SEQ ID NO: 3442 - protein, 7 aa, Artificial Sequence
  Description of Artificial Sequence: example ZFP
RSDELQR

SEQ ID NO: 3443 - protein, 7 aa, Artificial Sequence
  Description of Artificial Sequence: example ZFP
DRSHLAR

SEQ ID NO: 3444 - protein, 7 aa, Artificial Sequence
  Description of Artificial Sequence: example ZFP
ERGTLAR

SEQ ID NO: 3445 - protein, 7 aa, Artificial Sequence
  Description of Artificial Sequence: example ZFP
DRSDLTR

SEQ ID NO: 3446 - protein, 7 aa, Artificial Sequence
  Description of Artificial Sequence: example ZFP
ERGTLAR

SEQ ID NO: 3447 - protein, 7 aa, Artificial Sequence
  Description of Artificial Sequence: example ZFP
DRSDLTR

SEQ ID NO: 3448 - protein, 7 aa, Artificial Sequence
  Description of Artificial Sequence: example ZFP
ERGTLAR

SEQ ID NO: 3449 - protein, 7 aa, Artificial Sequence
  Description of Artificial Sequence: example ZFP
RGDALTS

SEQ ID NO: 3450 - protein, 7 aa, Artificial Sequence
  Description of Artificial Sequence: example ZFP
RSDNLAR

SEQ ID NO: 3451 - protein, 7 aa, Artificial Sequence
  Description of Artificial Sequence: example ZFP
RSDDLTT

SEQ ID NO: 3452 - protein, 7 aa, Artificial Sequence
  Description of Artificial Sequence: example ZFP
RSDDLTK

SEQ ID NO: 3453 - protein, 7 aa, Artificial Sequence
  Description of Artificial Sequence: example ZFP
DRSHLAR

SEQ ID NO: 3454 - protein, 7 aa, Artificial Sequence
  Description of Artificial Sequence: example ZFP
DRSHLAR

SEQ ID NO: 3455 - protein, 7 aa, Artificial Sequence
  Description of Artificial Sequence: example ZFP
DRSHLAR

SEQ ID NO: 3456 - protein, 7 aa, Artificial Sequence
  Description of Artificial Sequence: example ZFP
DRSHLAR

SEQ ID NO: 3457 - protein, 7 aa, Artificial Sequence
  Description of Artificial Sequence: example ZFP
DRSDLTR

SEQ ID NO: 3458 - protein, 7 aa, Artificial Sequence
  Description of Artificial Sequence: example ZFP
DRSDLTR

SEQ ID NO: 3459 - protein, 7 aa, Artificial Sequence
  Description of Artificial Sequence: example ZFP
ERGTLAR

SEQ ID NO: 3460 - protein, 7 aa, Artificial Sequence
  Description of Artificial Sequence: example ZFP
DRSDLTR

SEQ ID NO: 3461 - protein, 7 aa, Artificial Sequence
  Description of Artificial Sequence: example ZFP
RSDHLTT

SEQ ID NO: 3462 - protein, 7 aa, Artificial Sequence
  Description of Artificial Sequence: example ZFP
RSDNLAR

SEQ ID NO: 3463 - protein, 7 aa, Artificial Sequence
  Description of Artificial Sequence: example ZFP
RSDALAR

SEQ ID NO: 3464 - protein, 7 aa, Artificial Sequence
  Description of Artificial Sequence: example ZFP
RSDALAR

SEQ ID NO: 3465 - protein, 7 aa, Artificial Sequence
  Description of Artificial Sequence: example ZFP
QSSDLTR

SEQ ID NO: 3466 - protein, 7 aa, Artificial Sequence
  Description of Artificial Sequence: example ZFP
RSDHLTT

SEQ ID NO: 3467 - protein, 7 aa, Artificial Sequence
  Description of Artificial Sequence: example ZFP
RSDNLTQ

SEQ ID NO: 3468 - protein, 7 aa, Artificial Sequence
  Description of Artificial Sequence: example ZFP
RSDNLTQ

SEQ ID NO: 3469 - protein, 7 aa, Artificial Sequence
  Description of Artificial Sequence: example ZFP
RLDNLTA

SEQ ID NO: 3470 - protein, 7 aa, Artificial Sequence
  Description of Artificial Sequence: example ZFP
RLDNLTA

SEQ ID NO: 3471 - protein, 7 aa, Artificial Sequence
  Description of Artificial Sequence: example ZFP
RSDNLAR

SEQ ID NO: 3472 - protein, 7 aa, Artificial Sequence
  Description of Artificial Sequence: example ZFP
TSGNLVR

SEQ ID NO: 3473 - protein, 7 aa, Artificial Sequence
  Description of Artificial Sequence: example ZFP
RSDNLAR

SEQ ID NO: 3474 - protein, 7 aa, Artificial Sequence
  Description of Artificial Sequence: example ZFP
RSDNLAR

SEQ ID NO: 3475 - protein, 7 aa, Artificial Sequence
  Description of Artificial Sequence: example ZFP
RSDHLTR

SEQ ID NO: 3476 - protein, 7 aa, Artificial Sequence
  Description of Artificial Sequence: example ZFP
RSDNLTR

SEQ ID NO: 3477 - protein, 7 aa, Artificial Sequence
  Description of Artificial Sequence: example ZFP
TSGNLVR

SEQ ID NO: 3478 - protein, 7 aa, Artificial Sequence
  Description of Artificial Sequence: example ZFP
QSSDLTR

SEQ ID NO: 3479 - protein, 7 aa, Artificial Sequence
  Description of Artificial Sequence: example ZFP
RSDNLTR

SEQ ID NO: 3480 - protein, 7 aa, Artificial Sequence
  Description of Artificial Sequence: example ZFP
QSGHLQR

SEQ ID NO: 3481 - protein, 7 aa, Artificial Sequence
  Description of Artificial Sequence: example ZFP
QSGHLQR

SEQ ID NO: 3482 - protein, 7 aa, Artificial Sequence
  Description of Artificial Sequence: example ZFP
TSGNLVR

SEQ ID NO: 3483 - protein, 7 aa, Artificial Sequence
  Description of Artificial Sequence: example ZFP
TSGNLVR

SEQ ID NO: 3484 - protein, 7 aa, Artificial Sequence
  Description of Artificial Sequence: example ZFP
TSGNLVR

SEQ ID NO: 3485 - protein, 7 aa, Artificial Sequence
  Description of Artificial Sequence: example ZFP
QSSALTR

SEQ ID NO: 3486 - protein, 7 aa, Artificial Sequence
  Description of Artificial Sequence: example ZFP
RSDNLTQ

SEQ ID NO: 3487 - protein, 7 aa, Artificial Sequence
  Description of Artificial Sequence: example ZFP
RSDNLTQ

SEQ ID NO: 3488 - protein, 7 aa, Artificial Sequence
  Description of Artificial Sequence: example ZFP
RSDNLTQ

SEQ ID NO: 3489 - protein, 7 aa, Artificial Sequence
  Description of Artificial Sequence: example ZFP
RSDNLTQ

SEQ ID NO: 3490 - protein, 7 aa, Artificial Sequence
  Description of Artificial Sequence: example ZFP
RSDNLTQ

SEQ ID NO: 3491 - protein, 7 aa, Artificial Sequence
  Description of Artificial Sequence: example ZFP
DRSDLTR

SEQ ID NO: 3492 - protein, 7 aa, Artificial Sequence
  Description of Artificial Sequence: example ZFP
MSHHLTQ

SEQ ID NO: 3493 - protein, 7 aa, Artificial Sequence
  Description of Artificial Sequence: example ZFP
TSGHLVQ

SEQ ID NO: 3494 - protein, 7 aa, Artificial Sequence
  Description of Artificial Sequence: example ZFP
TSDHLAS

SEQ ID NO: 3495 - protein, 7 aa, Artificial Sequence
  Description of Artificial Sequence: example ZFP
TSDHLAS

SEQ ID NO: 3496 - protein, 7 aa, Artificial Sequence
  Description of Artificial Sequence: example ZFP
MSHHLTT

SEQ ID NO: 3497 - protein, 7 aa, Artificial Sequence
  Description of Artificial Sequence: example ZFP
RSDALSR

SEQ ID NO: 3498 - protein, 7 aa, Artificial Sequence
  Description of Artificial Sequence: example ZFP
QSGHLTT

SEQ ID NO: 3499 - protein, 7 aa, Artificial Sequence
  Description of Artificial Sequence: example ZFP
TTSALAS

SEQ ID NO: 3500 - protein, 7 aa, Artificial Sequence
  Description of Artificial Sequence: example ZFP
RSDNLTQ

SEQ ID NO: 3501 - protein, 7 aa, Artificial Sequence
  Description of Artificial Sequence: example ZFP
QSGHLTT

SEQ ID NO: 3502 - protein, 7 aa, Artificial Sequence
  Description of Artificial Sequence: example ZFP
TSGSLTR

SEQ ID NO: 3503 - protein, 7 aa, Artificial Sequence
  Description of Artificial Sequence: example ZFP
DSSKLSR

SEQ ID NO: 3504 - protein, 7 aa, Artificial Sequence
  Description of Artificial Sequence: example ZFP
RSDHLTT

SEQ ID NO: 3505 - protein, 7 aa, Artificial Sequence
  Description of Artificial Sequence: example ZFP
RSDHLTT

SEQ ID NO: 3506 - protein, 7 aa, Artificial Sequence
  Description of Artificial Sequence: example ZFP
QRSALAS

SEQ ID NO: 3507 - protein, 7 aa, Artificial Sequence
  Description of Artificial Sequence: example ZFP
RSDHLTR

SEQ ID NO: 3508 - protein, 7 aa, Artificial Sequence
  Description of Artificial Sequence: example ZFP
QSSDLTR

SEQ ID NO: 3509 - protein, 7 aa, Artificial Sequence
  Description of Artificial Sequence: example ZFP
QSSALTR

SEQ ID NO: 3510 - protein, 7 aa, Artificial Sequence
  Description of Artificial Sequence: example ZFP
TSGALTR

SEQ ID NO: 3511 - protein, 7 aa, Artificial Sequence
  Description of Artificial Sequence: example ZFP
RSDNLAR

SEQ ID NO: 3512 - protein, 7 aa, Artificial Sequence
  Description of Artificial Sequence: example ZFP
RSDALTQ

SEQ ID NO: 3513 - protein, 7 aa, Artificial Sequence
  Description of Artificial Sequence: example ZFP
RSDALRQ

SEQ ID NO: 3514 - protein, 7 aa, Artificial Sequence
  Description of Artificial Sequence: example ZFP
RSDNLTQ

SEQ ID NO: 3515 - protein, 7 aa, Artificial Sequence
  Description of Artificial Sequence: example ZFP
RSDSLAR

SEQ ID NO: 3516 - protein, 7 aa, Artificial Sequence
  Description of Artificial Sequence: example ZFP
RSDNLRQ

SEQ ID NO: 3517 - protein, 7 aa, Artificial Sequence
  Description of Artificial Sequence: example ZFP
RSDALAR

SEQ ID NO: 3518 - protein, 7 aa, Artificial Sequence
  Description of Artificial Sequence: example ZFP
RSDALAQ

SEQ ID NO: 3519 - protein, 7 aa, Artificial Sequence
  Description of Artificial Sequence: example ZFP
RSDALAQ

SEQ ID NO: 3520 - protein, 7 aa, Artificial Sequence
  Description of Artificial Sequence: example ZFP
QSGDLRT

SEQ ID NO: 3521 - protein, 7 aa, Artificial Sequence
  Description of Artificial Sequence: example ZFP
RSDNLRE

SEQ ID NO: 3522 - protein, 7 aa, Artificial Sequence
  Description of Artificial Sequence: example ZFP
RSDNLRE

SEQ ID NO: 3523 - protein, 7 aa, Artificial Sequence
  Description of Artificial Sequence: example ZFP
RSDNLQR

SEQ ID NO: 3524 - protein, 7 aa, Artificial Sequence
  Description of Artificial Sequence: example ZFP
QSGDLRT

SEQ ID NO: 3525 - protein, 7 aa, Artificial Sequence
  Description of Artificial Sequence: example ZFP
TSANLSR

SEQ ID NO: 3526 - protein, 7 aa, Artificial Sequence
  Description of Artificial Sequence: example ZFP
RSDNLRQ

SEQ ID NO: 3527 - protein, 7 aa, Artificial Sequence
  Description of Artificial Sequence: example ZFP
RSDNLRQ

SEQ ID NO: 3528 - protein, 7 aa, Artificial Sequence
  Description of Artificial Sequence: example ZFP
RSDNLRQ

SEQ ID NO: 3529 - protein, 7 aa, Artificial Sequence
  Description of Artificial Sequence: example ZFP
RSDSLAR

SEQ ID NO: 3530 - protein, 7 aa, Artificial Sequence
  Description of Artificial Sequence: example ZFP
RSDNLRE

SEQ ID NO: 3531 - protein, 7 aa, Artificial Sequence
  Description of Artificial Sequence: example ZFP
RSDNLRE

SEQ ID NO: 3532 - protein, 7 aa, Artificial Sequence
  Description of Artificial Sequence: example ZFP
RSDNLRE

SEQ ID NO: 3533 - protein, 7 aa, Artificial Sequence
  Description of Artificial Sequence: example ZFP
RSDNLAR

SEQ ID NO: 3534 - protein, 7 aa, Artificial Sequence
  Description of Artificial Sequence: example ZFP
RSDALRQ

SEQ ID NO: 3535 - protein, 7 aa, Artificial Sequence
  Description of Artificial Sequence: example ZFP
DRSNLTR

SEQ ID NO: 3536 - protein, 7 aa, Artificial Sequence
  Description of Artificial Sequence: example ZFP
RSDALTS

SEQ ID NO: 3537 - protein, 7 aa, Artificial Sequence
  Description of Artificial Sequence: example ZFP
RSDALTS

SEQ ID NO: 3538 - protein, 7 aa, Artificial Sequence
  Description of Artificial Sequence: example ZFP
RSDSLAR

SEQ ID NO: 3539 - protein, 7 aa, Artificial Sequence
  Description of Artificial Sequence: example ZFP
RSDSLAR

SEQ ID NO: 3540 - protein, 7 aa, Artificial Sequence
  Description of Artificial Sequence: example ZFP
RSDHLSK

SEQ ID NO: 3541 - protein, 7 aa, Artificial Sequence
  Description of Artificial Sequence: example ZFP
RSDHLSK

SEQ ID NO: 3542 - protein, 7 aa, Artificial Sequence
  Description of Artificial Sequence: example ZFP
RSDKLSR

SEQ ID NO: 3543 - protein, 7 aa, Artificial Sequence
  Description of Artificial Sequence: example ZFP
RSDHLSK

SEQ ID NO: 3544 - protein, 7 aa, Artificial Sequence
  Description of Artificial Sequence: example ZFP
RSDKLSR

SEQ ID NO: 3545 - protein, 7 aa, Artificial Sequence
  Description of Artificial Sequence: example ZFP
RSDHLSK

SEQ ID NO: 3546 - protein, 7 aa, Artificial Sequence
  Description of Artificial Sequence: example ZFP
MSHHLSR

SEQ ID NO: 3547 - protein, 7 aa, Artificial Sequence
  Description of Artificial Sequence: example ZFP
MSHHLSR

SEQ ID NO: 3548 - protein, 7 aa, Artificial Sequence
  Description of Artificial Sequence: example ZFP
QSSHLAR

SEQ ID NO: 3549 - protein, 7 aa, Artificial Sequence
  Description of Artificial Sequence: example ZFP
QSSHLAR

SEQ ID NO: 3550 - protein, 7 aa, Artificial Sequence
  Description of Artificial Sequence: example ZFP
RSDNLAR

SEQ ID NO: 3551 - protein, 7 aa, Artificial Sequence
  Description of Artificial Sequence: example ZFP
RSDNLAR

SEQ ID NO: 3552 - protein, 7 aa, Artificial Sequence
  Description of Artificial Sequence: example ZFP
RSDERKR

SEQ ID NO: 3553 - protein, 7 aa, Artificial Sequence
  Description of Artificial Sequence: example ZFP
RSDERKR

SEQ ID NO: 3554 - protein, 7 aa, Artificial Sequence
  Description of Artificial Sequence: example ZFP
RSDNLAR

SEQ ID NO: 3555 - protein, 7 aa, Artificial Sequence
  Description of Artificial Sequence: example ZFP
RSDNLAR

SEQ ID NO: 3556 - protein, 7 aa, Artificial Sequence
  Description of Artificial Sequence: example ZFP
RSDNLAR

SEQ ID NO: 3557 - protein, 7 aa, Artificial Sequence
  Description of Artificial Sequence: example ZFP
RSDNLAR

SEQ ID NO: 3558 - protein, 7 aa, Artificial Sequence
  Description of Artificial Sequence: example ZFP
RSDALAR

SEQ ID NO: 3559 - protein, 7 aa, Artificial Sequence
  Description of Artificial Sequence: example ZFP
RSDALAR

SEQ ID NO: 3560 - protein, 7 aa, Artificial Sequence
  Description of Artificial Sequence: example ZFP
RSDALAR

SEQ ID NO: 3561 - protein, 7 aa, Artificial Sequence
  Description of Artificial Sequence: example ZFP
ERGTLAR

SEQ ID NO: 3562 - protein, 7 aa, Artificial Sequence
  Description of Artificial Sequence: example ZFP
DRSDLTR

SEQ ID NO: 3563 - protein, 7 aa, Artificial Sequence
  Description of Artificial Sequence: example ZFP
RSDNLRE

SEQ ID NO: 3564 - protein, 7 aa, Artificial Sequence
  Description of Artificial Sequence: example ZFP
RSDNLRE

SEQ ID NO: 3565 - protein, 7 aa, Artificial Sequence
  Description of Artificial Sequence: example ZFP
RSDALRE

SEQ ID NO: 3566 - protein, 7 aa, Artificial Sequence
  Description of Artificial Sequence: example ZFP
RSDALRE

SEQ ID NO: 3567 - protein, 7 aa, Artificial Sequence
  Description of Artificial Sequence: example ZFP
RSDALRE

SEQ ID NO: 3568 - protein, 7 aa, Artificial Sequence
  Description of Artificial Sequence: example ZFP
RSDALRE

SEQ ID NO: 3569 - protein, 7 aa, Artificial Sequence
  Description of Artificial Sequence: example ZFP
RSDNLRE

SEQ ID NO: 3570 - protein, 7 aa, Artificial Sequence
  Description of Artificial Sequence: example ZFP
RSDELRE

SEQ ID NO: 3571 - protein, 7 aa, Artificial Sequence
  Description of Artificial Sequence: example ZFP
RSDELRE

SEQ ID NO: 3572 - protein, 7 aa, Artificial Sequence
  Description of Artificial Sequence: example ZFP
DRSNLTR

SEQ ID NO: 3573 - protein, 7 aa, Artificial Sequence
  Description of Artificial Sequence: example ZFP
EKANLTR

SEQ ID NO: 3574 - protein, 7 aa, Artificial Sequence
  Description of Artificial Sequence: example ZFP
MSHHLSR

SEQ ID NO: 3575 - protein, 7 aa, Artificial Sequence
  Description of Artificial Sequence: example ZFP
TSGHLVR

SEQ ID NO: 3576 - protein, 7 aa, Artificial Sequence
  Description of Artificial Sequence: example ZFP
MSHHLSR

SEQ ID NO: 3577 - protein, 7 aa, Artificial Sequence
  Description of Artificial Sequence: example ZFP
MSHHLSR

SEQ ID NO: 3578 - protein, 7 aa, Artificial Sequence
  Description of Artificial Sequence: example ZFP
RSDNLTQ

SEQ ID NO: 3579 - protein, 7 aa, Artificial Sequence
  Description of Artificial Sequence: example ZFP
RSDNLTQ

SEQ ID NO: 3580 - protein, 7 aa, Artificial Sequence
  Description of Artificial Sequence: example ZFP
RSDHLSR

SEQ ID NO: 3581 - protein, 7 aa, Artificial Sequence
  Description of Artificial Sequence: example ZFP
RSDHLSR

SEQ ID NO: 3582 - protein, 7 aa, Artificial Sequence
  Description of Artificial Sequence: example ZFP
RSDHLSK

SEQ ID NO: 3583 - protein, 7 aa, Artificial Sequence
  Description of Artificial Sequence: example ZFP
RSDNLRE

SEQ ID NO: 3584 - protein, 7 aa, Artificial Sequence
  Description of Artificial Sequence: example ZFP
QSGHLNQ

SEQ ID NO: 3585 - protein, 7 aa, Artificial Sequence
  Description of Artificial Sequence: example ZFP
RSDTLKQ

SEQ ID NO: 3586 - protein, 7 aa, Artificial Sequence
  Description of Artificial Sequence: example ZFP
QSGKLTQ

SEQ ID NO: 3587 - protein, 7 aa, Artificial Sequence
  Description of Artificial Sequence: example ZFP
RSDNLRE

SEQ ID NO: 3588 - protein, 7 aa, Artificial Sequence
  Description of Artificial Sequence: example ZFP
QRAHLAR

SEQ ID NO: 3589 - protein, 7 aa, Artificial Sequence
  Description of Artificial Sequence: example ZFP
RSDERKR

SEQ ID NO: 3590 - protein, 7 aa, Artificial Sequence
  Description of Artificial Sequence: example ZFP
RSDTLRS

SEQ ID NO: 3591 - protein, 7 aa, Artificial Sequence
  Description of Artificial Sequence: example ZFP
RSDTLRS

SEQ ID NO: 3592 - protein, 7 aa, Artificial Sequence
  Description of Artificial Sequence: example ZFP
QRASLTR

SEQ ID NO: 3593 - protein, 7 aa, Artificial Sequence
  Description of Artificial Sequence: example ZFP
RLHNLAR

SEQ ID NO: 3594 - protein, 7 aa, Artificial Sequence
  Description of Artificial Sequence: example ZFP
RLHNLAR

SEQ ID NO: 3595 - protein, 7 aa, Artificial Sequence
  Description of Artificial Sequence: example ZFP
RSDNLSR

SEQ ID NO: 3596 - protein, 7 aa, Artificial Sequence
  Description of Artificial Sequence: example ZFP
RSDNLAR

SEQ ID NO: 3597 - protein, 7 aa, Artificial Sequence
  Description of Artificial Sequence: example ZFP
RSDSLTK

SEQ ID NO: 3598 - protein, 7 aa, Artificial Sequence
  Description of Artificial Sequence: example ZFP
DRSNLTR

SEQ ID NO: 3599 - protein, 7 aa, Artificial Sequence
  Description of Artificial Sequence: example ZFP
RSDNLAR

SEQ ID NO: 3600 - protein, 7 aa, Artificial Sequence
  Description of Artificial Sequence: example ZFP
DRSNLTR

SEQ ID NO: 3601 - protein, 7 aa, Artificial Sequence
  Description of Artificial Sequence: example ZFP
RSDTLKK

SEQ ID NO: 3602 - protein, 7 aa, Artificial Sequence
  Description of Artificial Sequence: example ZFP
RSDNLRE

SEQ ID NO: 3603 - protein, 7 aa, Artificial Sequence
  Description of Artificial Sequence: example ZFP
RSDALRE

SEQ ID NO: 3604 - protein, 7 aa, Artificial Sequence
  Description of Artificial Sequence: example ZFP
QRASLAR

SEQ ID NO: 3605 - protein, 7 aa, Artificial Sequence
  Description of Artificial Sequence: example ZFP
RSDHLTQ

SEQ ID NO: 3606 - protein, 7 aa, Artificial Sequence
  Description of Artificial Sequence: example ZFP
RSDTLKQ

SEQ ID NO: 3607 - protein, 7 aa, Artificial Sequence
  Description of Artificial Sequence: example ZFP
RSDNLAR

SEQ ID NO: 3608 - protein, 7 aa, Artificial Sequence
  Description of Artificial Sequence: example ZFP
RSDHLSR

SEQ ID NO: 3609 - protein, 7 aa, Artificial Sequence
  Description of Artificial Sequence: example ZFP
RSDTLTQ

SEQ ID NO: 3610 - protein, 7 aa, Artificial Sequence
  Description of Artificial Sequence: example ZFP
RSDALAR

SEQ ID NO: 3611 - protein, 7 aa, Artificial Sequence
  Description of Artificial Sequence: example ZFP
RSDELQR

SEQ ID NO: 3612 - protein, 7 aa, Artificial Sequence
  Description of Artificial Sequence: example ZFP
TSGHLVR

SEQ ID NO: 3613 - protein, 7 aa, Artificial Sequence
  Description of Artificial Sequence: example ZFP
RSDALAR

SEQ ID NO: 3614 - protein, 7 aa, Artificial Sequence
  Description of Artificial Sequence: example ZFP
RSDALAR

SEQ ID NO: 3615 - protein, 7 aa, Artificial Sequence
  Description of Artificial Sequence: example ZFP
RSDALAR

SEQ ID NO: 3616 - protein, 7 aa, Artificial Sequence
  Description of Artificial Sequence: example ZFP
QRASLAR

SEQ ID NO: 3617 - protein, 7 aa, Artificial Sequence
  Description of Artificial Sequence: example ZFP
QRASLAR

SEQ ID NO: 3618 - protein, 7 aa, Artificial Sequence
  Description of Artificial Sequence: example ZFP
RSDHLTR

SEQ ID NO: 3619 - protein, 7 aa, Artificial Sequence
  Description of Artificial Sequence: example ZFP
RSDHLSK

SEQ ID NO: 3620 - protein, 7 aa, Artificial Sequence
  Description of Artificial Sequence: example ZFP
QSHDLTK

SEQ ID NO: 3621 - protein, 7 aa, Artificial Sequence
  Description of Artificial Sequence: example ZFP
RSDNLRE

SEQ ID NO: 3622 - protein, 7 aa, Artificial Sequence
  Description of Artificial Sequence: example ZFP
RSDNLRE

SEQ ID NO: 3623 - protein, 7 aa, Artificial Sequence
  Description of Artificial Sequence: example ZFP
RSDHLSR

SEQ ID NO: 3624 - protein, 7 aa, Artificial Sequence
  Description of Artificial Sequence: example ZFP
RSDHLSR

SEQ ID NO: 3625 - protein, 7 aa, Artificial Sequence
  Description of Artificial Sequence: example ZFP
RSDHLSR

SEQ ID NO: 3626 - protein, 7 aa, Artificial Sequence
  Description of Artificial Sequence: example ZFP
RSDNLRE

SEQ ID NO: 3627 - protein, 7 aa, Artificial Sequence
  Description of Artificial Sequence: example ZFP
RSDNLRE

SEQ ID NO: 3628 - protein, 7 aa, Artificial Sequence
  Description of Artificial Sequence: example ZFP
RSDNLRE

SEQ ID NO: 3629 - protein, 7 aa, Artificial Sequence
  Description of Artificial Sequence: example ZFP
RSDNLVR

SEQ ID NO: 3630 - protein, 7 aa, Artificial Sequence
  Description of Artificial Sequence: example ZFP
RSDNLTT

SEQ ID NO: 3631 - protein, 7 aa, Artificial Sequence
  Description of Artificial Sequence: example ZFP
RSDNLTT

SEQ ID NO: 3632 - protein, 7 aa, Artificial Sequence
  Description of Artificial Sequence: example ZFP
QSSDLQR

SEQ ID NO: 3633 - protein, 7 aa, Artificial Sequence
  Description of Artificial Sequence: example ZFP
TSGDLTR

SEQ ID NO: 3634 - protein, 7 aa, Artificial Sequence
  Description of Artificial Sequence: example ZFP
QSSDLQR

SEQ ID NO: 3635 - protein, 7 aa, Artificial Sequence
  Description of Artificial Sequence: example ZFP
TSGDLTR

SEQ ID NO: 3636 - protein, 7 aa, Artificial Sequence
  Description of Artificial Sequence: example ZFP
RSDHLSR

SEQ ID NO: 3637 - protein, 7 aa, Artificial Sequence
  Description of Artificial Sequence: example ZFP
RSDHLSR

SEQ ID NO: 3638 - protein, 7 aa, Artificial Sequence
  Description of Artificial Sequence: example ZFP
RSDERKR

SEQ ID NO: 3639 - protein, 7 aa, Artificial Sequence
  Description of Artificial Sequence: example ZFP
QSSALTR

SEQ ID NO: 3640 - protein, 7 aa, Artificial Sequence
  Description of Artificial Sequence: example ZFP
TSGSLTR

SEQ ID NO: 3641 - protein, 7 aa, Artificial Sequence
  Description of Artificial Sequence: example ZFP
MSHALSR

SEQ ID NO: 3642 - protein, 7 aa, Artificial Sequence
  Description of Artificial Sequence: example ZFP
RSDERKR

SEQ ID NO: 3643 - protein, 7 aa, Artificial Sequence
  Description of Artificial Sequence: example ZFP
RSDHLTT

SEQ ID NO: 3644 - protein, 7 aa, Artificial Sequence
  Description of Artificial Sequence: example ZFP
RSDNLVR

SEQ ID NO: 3645 - protein, 7 aa, Artificial Sequence
  Description of Artificial Sequence: example ZFP
RSDNLVR

SEQ ID NO: 3646 - protein, 7 aa, Artificial Sequence
  Description of Artificial Sequence: example ZFP
QSGDLTR

SEQ ID NO: 3647 - protein, 7 aa, Artificial Sequence
  Description of Artificial Sequence: example ZFP
QSGSLTR

SEQ ID NO: 3648 - protein, 7 aa, Artificial Sequence
  Description of Artificial Sequence: example ZFP
RSDHLSR

SEQ ID NO: 3649 - protein, 7 aa, Artificial Sequence
  Description of Artificial Sequence: example ZFP
RSDHLSR

SEQ ID NO: 3650 - protein, 7 aa, Artificial Sequence
  Description of Artificial Sequence: example ZFP
QRAHLAR

SEQ ID NO: 3651 - protein, 7 aa, Artificial Sequence
  Description of Artificial Sequence: example ZFP
QRAHLAR

SEQ ID NO: 3652 - protein, 7 aa, Artificial Sequence
  Description of Artificial Sequence: example ZFP
RSDALTR

SEQ ID NO: 3653 - protein, 7 aa, Artificial Sequence
  Description of Artificial Sequence: example ZFP
RSDERKR

SEQ ID NO: 3654 - protein, 7 aa, Artificial Sequence
  Description of Artificial Sequence: example ZFP
RSDERKR

SEQ ID NO: 3655 - protein, 7 aa, Artificial Sequence
  Description of Artificial Sequence: example ZFP
RSDHLSR

SEQ ID NO: 3656 - protein, 7 aa, Artificial Sequence
  Description of Artificial Sequence: example ZFP
RSDHLSR

SEQ ID NO: 3657 - protein, 7 aa, Artificial Sequence
  Description of Artificial Sequence: example ZFP
RSDALRE

SEQ ID NO: 3658 - protein, 7 aa, Artificial Sequence
  Description of Artificial Sequence: example ZFP
RSDHLSR

SEQ ID NO: 3659 - protein, 7 aa, Artificial Sequence
  Description of Artificial Sequence: example ZFP
RSDALRE

SEQ ID NO: 3660 - protein, 7 aa, Artificial Sequence
  Description of Artificial Sequence: example ZFP
RSDALRE

SEQ ID NO: 3661 - protein, 7 aa, Artificial Sequence
  Description of Artificial Sequence: example ZFP
MSHHLSR

SEQ ID NO: 3662 - protein, 7 aa, Artificial Sequence
  Description of Artificial Sequence: example ZFP
QSSHLAR

SEQ ID NO: 3663 - protein, 7 aa, Artificial Sequence
  Description of Artificial Sequence: example ZFP
RSDHLTR

SEQ ID NO: 3664 - protein, 7 aa, Artificial Sequence
  Description of Artificial Sequence: example ZFP
RSDHLAE

SEQ ID NO: 3665 - protein, 7 aa, Artificial Sequence
  Description of Artificial Sequence: example ZFP
RSDHLRE

SEQ ID NO: 3666 - protein, 7 aa, Artificial Sequence
  Description of Artificial Sequence: example ZFP
DRSNLTR

SEQ ID NO: 3667 - protein, 7 aa, Artificial Sequence
  Description of Artificial Sequence: example ZFP
RSDNLTQ

SEQ ID NO: 3668 - protein, 7 aa, Artificial Sequence
  Description of Artificial Sequence: example ZFP
QRASLAR

SEQ ID NO: 3669 - protein, 7 aa, Artificial Sequence
  Description of Artificial Sequence: example ZFP
DRSDLTR

SEQ ID NO: 3670 - protein, 7 aa, Artificial Sequence
  Description of Artificial Sequence: example ZFP
RSDERKR

SEQ ID NO: 3671 - protein, 7 aa, Artificial Sequence
  Description of Artificial Sequence: example ZFP
RSDERKR

SEQ ID NO: 3672 - protein, 7 aa, Artificial Sequence
  Description of Artificial Sequence: example ZFP
RSDHLSR

SEQ ID NO: 3673 - protein, 7 aa, Artificial Sequence
  Description of Artificial Sequence: example ZFP
RSDHLSR

SEQ ID NO: 3674 - protein, 7 aa, Artificial Sequence
  Description of Artificial Sequence: example ZFP
RSDNLAR

SEQ ID NO: 3675 - protein, 7 aa, Artificial Sequence
  Description of Artificial Sequence: example ZFP
DRSDLTR

SEQ ID NO: 3676 - protein, 7 aa, Artificial Sequence
  Description of Artificial Sequence: example ZFP
RSDERKR

SEQ ID NO: 3677 - protein, 7 aa, Artificial Sequence
  Description of Artificial Sequence: example ZFP
RSDALTR

SEQ ID NO: 3678 - protein, 7 aa, Artificial Sequence
  Description of Artificial Sequence: example ZFP
RSDALRQ

SEQ ID NO: 3679 - protein, 7 aa, Artificial Sequence
  Description of Artificial Sequence: example ZFP
RSDNLTQ

SEQ ID NO: 3680 - protein, 7 aa, Artificial Sequence
  Description of Artificial Sequence: example ZFP
RSDNLTQ

SEQ ID NO: 3681 - protein, 7 aa, Artificial Sequence
  Description of Artificial Sequence: example ZFP
RSDHLRE

SEQ ID NO: 3682 - protein, 7 aa, Artificial Sequence
  Description of Artificial Sequence: example ZFP
RSDALRE

SEQ ID NO: 3683 - protein, 7 aa, Artificial Sequence
  Description of Artificial Sequence: example ZFP
RSDALRE

SEQ ID NO: 3684 - protein, 7 aa, Artificial Sequence
  Description of Artificial Sequence: example ZFP
RSDERKR

SEQ ID NO: 3685 - protein, 7 aa, Artificial Sequence
  Description of Artificial Sequence: example ZFP
RSDNLRE

SEQ ID NO: 3686 - protein, 7 aa, Artificial Sequence
  Description of Artificial Sequence: example ZFP
RSDHLTQ

SEQ ID NO: 3687 - protein, 7 aa, Artificial Sequence
  Description of Artificial Sequence: example ZFP
RSDHLTQ

SEQ ID NO: 3688 - protein, 7 aa, Artificial Sequence
  Description of Artificial Sequence: example ZFP
RSDALRE

SEQ ID NO: 3689 - protein, 7 aa, Artificial Sequence
  Description of Artificial Sequence: example ZFP
RSDALRE

SEQ ID NO: 3690 - protein, 7 aa, Artificial Sequence
  Description of Artificial Sequence: example ZFP
RSDALRE

SEQ ID NO: 3691 - protein, 7 aa, Artificial Sequence
  Description of Artificial Sequence: example ZFP
RSDNLRE

SEQ ID NO: 3692 - protein, 7 aa, Artificial Sequence
  Description of Artificial Sequence: example ZFP
RSDNLRE

SEQ ID NO: 3693 - protein, 7 aa, Artificial Sequence
  Description of Artificial Sequence: example ZFP
RSDELRE

SEQ ID NO: 3694 - protein, 7 aa, Artificial Sequence
  Description of Artificial Sequence: example ZFP
QSGSLTR

SEQ ID NO: 3695 - protein, 7 aa, Artificial Sequence
  Description of Artificial Sequence: example ZFP
RSDNLTT

SEQ ID NO: 3696 - protein, 7 aa, Artificial Sequence
  Description of Artificial Sequence: example ZFP
RSDHLTT

SEQ ID NO: 3697 - protein, 7 aa, Artificial Sequence
  Description of Artificial Sequence: example ZFP
RSDHLTQ

SEQ ID NO: 3698 - protein, 7 aa, Artificial Sequence
  Description of Artificial Sequence: example ZFP
RSDALRE

SEQ ID NO: 3699 - protein, 7 aa, Artificial Sequence
  Description of Artificial Sequence: example ZFP
RSDALRE

SEQ ID NO: 3700 - protein, 7 aa, Artificial Sequence
  Description of Artificial Sequence: example ZFP
RSDNLTT

SEQ ID NO: 3701 - protein, 7 aa, Artificial Sequence
  Description of Artificial Sequence: example ZFP
RSDALTR

SEQ ID NO: 3702 - protein, 7 aa, Artificial Sequence
  Description of Artificial Sequence: example ZFP
RGDALTS

SEQ ID NO: 3703 - protein, 7 aa, Artificial Sequence
  Description of Artificial Sequence: example ZFP
RSDNLRE

SEQ ID NO: 3704 - protein, 7 aa, Artificial Sequence
  Description of Artificial Sequence: example ZFP
RSDNLTQ

SEQ ID NO: 3705 - protein, 7 aa, Artificial Sequence
  Description of Artificial Sequence: example ZFP
MSHHLSR

SEQ ID NO: 3706 - protein, 7 aa, Artificial Sequence
  Description of Artificial Sequence: example ZFP
RSDALTR

SEQ ID NO: 3707 - protein, 7 aa, Artificial Sequence
  Description of Artificial Sequence: example ZFP
RSDHLSR

SEQ ID NO: 3708 - protein, 7 aa, Artificial Sequence
  Description of Artificial Sequence: example ZFP
RSDHLSR

SEQ ID NO: 3709 - protein, 7 aa, Artificial Sequence
  Description of Artificial Sequence: example ZFP
RSDHLTT

SEQ ID NO: 3710 - protein, 7 aa, Artificial Sequence
  Description of Artificial Sequence: example ZFP
RSDERKR

SEQ ID NO: 3711 - protein, 7 aa, Artificial Sequence
  Description of Artificial Sequence: example ZFP
RSDTLRE

SEQ ID NO: 3712 - protein, 7 aa, Artificial Sequence
  Description of Artificial Sequence: example ZFP
RSDTLRE

SEQ ID NO: 3713 - protein, 7 aa, Artificial Sequence
  Description of Artificial Sequence: example ZFP
RSDNLRE

SEQ ID NO: 3714 - protein, 7 aa, Artificial Sequence
  Description of Artificial Sequence: example ZFP
RSDTLTQ

SEQ ID NO: 3715 - protein, 7 aa, Artificial Sequence
  Description of Artificial Sequence: example ZFP
RSDNLTQ

SEQ ID NO: 3716 - protein, 7 aa, Artificial Sequence
  Description of Artificial Sequence: example ZFP
RSDALTQ

SEQ ID NO: 3717 - protein, 7 aa, Artificial Sequence
  Description of Artificial Sequence: example ZFP
RGDALTS

SEQ ID NO: 3718 - protein, 7 aa, Artificial Sequence
  Description of Artificial Sequence: example ZFP
RSDALTK

SEQ ID NO: 3719 - protein, 7 aa, Artificial Sequence
  Description of Artificial Sequence: example ZFP
QSGNLTR

SEQ ID NO: 3720 - protein, 7 aa, Artificial Sequence
  Description of Artificial Sequence: example ZFP
QRASLAR

SEQ ID NO: 3721 - protein, 7 aa, Artificial Sequence
  Description of Artificial Sequence: example ZFP
RSDNLTQ

SEQ ID NO: 3722 - protein, 7 aa, Artificial Sequence
  Description of Artificial Sequence: example ZFP
RSDNLTQ

SEQ ID NO: 3723 - protein, 7 aa, Artificial Sequence
  Description of Artificial Sequence: example ZFP
RSDALRE

SEQ ID NO: 3724 - protein, 7 aa, Artificial Sequence
  Description of Artificial Sequence: example ZFP
RSDALRQ

SEQ ID NO: 3725 - protein, 7 aa, Artificial Sequence
  Description of Artificial Sequence: example ZFP
RSDALRQ

SEQ ID NO: 3726 - protein, 7 aa, Artificial Sequence
  Description of Artificial Sequence: example ZFP
RSDHLTQ

SEQ ID NO: 3727 - protein, 7 aa, Artificial Sequence
  Description of Artificial Sequence: example ZFP
RSDHLTQ

SEQ ID NO: 3728 - protein, 7 aa, Artificial Sequence
  Description of Artificial Sequence: example ZFP
RSDHLTT

SEQ ID NO: 3729 - protein, 7 aa, Artificial Sequence
  Description of Artificial Sequence: example ZFP
RSDNLAR

SEQ ID NO: 3730 - protein, 7 aa, Artificial Sequence
  Description of Artificial Sequence: example ZFP
RSDALTR

SEQ ID NO: 3731 - protein, 7 aa, Artificial Sequence
  Description of Artificial Sequence: example ZFP
RSDALTR

SEQ ID NO: 3732 - protein, 7 aa, Artificial Sequence
  Description of Artificial Sequence: example ZFP
RSDALTR

SEQ ID NO: 3733 - protein, 7 aa, Artificial Sequence
  Description of Artificial Sequence: example ZFP
RSDERKR

SEQ ID NO: 3734 - protein, 7 aa, Artificial Sequence
  Description of Artificial Sequence: example ZFP
RSSDRKR

SEQ ID NO: 3735 - protein, 7 aa, Artificial Sequence
  Description of Artificial Sequence: example ZFP
RSHDRKR

SEQ ID NO: 3736 - protein, 7 aa, Artificial Sequence
  Description of Artificial Sequence: example ZFP
RSDNLTQ

SEQ ID NO: 3737 - protein, 7 aa, Artificial Sequence
  Description of Artificial Sequence: example ZFP
QSSSLVR

SEQ ID NO: 3738 - protein, 7 aa, Artificial Sequence
  Description of Artificial Sequence: example ZFP
DRSDLTR

SEQ ID NO: 3739 - protein, 7 aa, Artificial Sequence
  Description of Artificial Sequence: example ZFP
RSDERKR

SEQ ID NO: 3740 - protein, 7 aa, Artificial Sequence
  Description of Artificial Sequence: example ZFP
ERGDLTR

SEQ ID NO: 3741 - protein, 7 aa, Artificial Sequence
  Description of Artificial Sequence: example ZFP
QSSDLRR

SEQ ID NO: 3742 - protein, 7 aa, Artificial Sequence
  Description of Artificial Sequence: example ZFP
QSSDLRR

SEQ ID NO: 3743 - protein, 7 aa, Artificial Sequence
  Description of Artificial Sequence: example ZFP
RSDNLTQ

SEQ ID NO: 3744 - protein, 7 aa, Artificial Sequence
  Description of Artificial Sequence: example ZFP
RSDALTR

SEQ ID NO: 3745 - protein, 7 aa, Artificial Sequence
  Description of Artificial Sequence: example ZFP
RSDTLRE

SEQ ID NO: 3746 - protein, 7 aa, Artificial Sequence
  Description of Artificial Sequence: example ZFP
RSDNLAR

SEQ ID NO: 3747 - protein, 7 aa, Artificial Sequence
  Description of Artificial Sequence: example ZFP
QSGSLTR

SEQ ID NO: 3748 - protein, 7 aa, Artificial Sequence
  Description of Artificial Sequence: example ZFP
RSDNLTQ

SEQ ID NO: 3749 - protein, 7 aa, Artificial Sequence
  Description of Artificial Sequence: example ZFP
RGDALTS

SEQ ID NO: 3750 - protein, 7 aa, Artificial Sequence
  Description of Artificial Sequence: example ZFP
RSDNLRE

SEQ ID NO: 3751 - protein, 7 aa, Artificial Sequence
  Description of Artificial Sequence: example ZFP
RSDNLRE

SEQ ID NO: 3752 - protein, 7 aa, Artificial Sequence
  Description of Artificial Sequence: example ZFP
RSDNLTQ

SEQ ID NO: 3753 - protein, 7 aa, Artificial Sequence
  Description of Artificial Sequence: example ZFP
RSDNLTQ

SEQ ID NO: 3754 - protein, 7 aa, Artificial Sequence
  Description of Artificial Sequence: example ZFP
ERGTLAR

SEQ ID NO: 3755 - protein, 7 aa, Artificial Sequence
  Description of Artificial Sequence: example ZFP
RSDALRE

SEQ ID NO: 3756 - protein, 7 aa, Artificial Sequence
  Description of Artificial Sequence: example ZFP
QRASLAR

SEQ ID NO: 3757 - protein, 7 aa, Artificial Sequence
  Description of Artificial Sequence: example ZFP
RSDALRQ

SEQ ID NO: 3758 - protein, 7 aa, Artificial Sequence
  Description of Artificial Sequence: example ZFP
RSDSLNQ

SEQ ID NO: 3759 - protein, 7 aa, Artificial Sequence
  Description of Artificial Sequence: example ZFP
RSDSLNQ

SEQ ID NO: 3760 - protein, 7 aa, Artificial Sequence
  Description of Artificial Sequence: example ZFP
RSDALTQ

SEQ ID NO: 3761 - protein, 7 aa, Artificial Sequence
  Description of Artificial Sequence: example ZFP
RSDALTQ

SEQ ID NO: 3762 - protein, 7 aa, Artificial Sequence
  Description of Artificial Sequence: example ZFP
RSDNLTR

SEQ ID NO: 3763 - protein, 7 aa, Artificial Sequence
  Description of Artificial Sequence: example ZFP
RSSNLTR

SEQ ID NO: 3764 - protein, 7 aa, Artificial Sequence
  Description of Artificial Sequence: example ZFP
QSGNLTR

SEQ ID NO: 3765 - protein, 7 aa, Artificial Sequence
  Description of Artificial Sequence: example ZFP
RSDALTQ

SEQ ID NO: 3766 - protein, 7 aa, Artificial Sequence
  Description of Artificial Sequence: example ZFP
RSDALTQ

SEQ ID NO: 3767 - protein, 7 aa, Artificial Sequence
  Description of Artificial Sequence: example ZFP
RSDALTQ

SEQ ID NO: 3768 - protein, 7 aa, Artificial Sequence
  Description of Artificial Sequence: example ZFP
RSDALRE

SEQ ID NO: 3769 - protein, 7 aa, Artificial Sequence
  Description of Artificial Sequence: example ZFP
QRAHLAR

SEQ ID NO: 3770 - protein, 7 aa, Artificial Sequence
  Description of Artificial Sequence: example ZFP
QRAHLAR

SEQ ID NO: 3771 - protein, 7 aa, Artificial Sequence
  Description of Artificial Sequence: example ZFP
RSDHLRE

SEQ ID NO: 3772 - protein, 7 aa, Artificial Sequence
  Description of Artificial Sequence: example ZFP
RSDERKR

SEQ ID NO: 3773 - protein, 7 aa, Artificial Sequence
  Description of Artificial Sequence: example ZFP
RSDNLRE

SEQ ID NO: 3774 - protein, 7 aa, Artificial Sequence
  Description of Artificial Sequence: example ZFP
RSDTLRE

SEQ ID NO: 3775 - protein, 7 aa, Artificial Sequence
  Description of Artificial Sequence: example ZFP
QSGSLTR

SEQ ID NO: 3776 - protein, 7 aa, Artificial Sequence
  Description of Artificial Sequence: example ZFP
RSDNLRE

SEQ ID NO: 3777 - protein, 7 aa, Artificial Sequence
  Description of Artificial Sequence: example ZFP
QSGNLTR

SEQ ID NO: 3778 - protein, 7 aa, Artificial Sequence
  Description of Artificial Sequence: example ZFP
RSDALTQ

SEQ ID NO: 3779 - protein, 7 aa, Artificial Sequence
  Description of Artificial Sequence: example ZFP
RSDALTR

SEQ ID NO: 3780 - protein, 7 aa, Artificial Sequence
  Description of Artificial Sequence: example ZFP
QSANLTR

SEQ ID NO: 3781 - protein, 7 aa, Artificial Sequence
  Description of Artificial Sequence: example ZFP
RSDERKR

SEQ ID NO: 3782 - protein, 7 aa, Artificial Sequence
  Description of Artificial Sequence: example ZFP
RSDNLTQ

SEQ ID NO: 3783 - protein, 7 aa, Artificial Sequence
  Description of Artificial Sequence: example ZFP
RSDNLTQ

SEQ ID NO: 3784 - protein, 7 aa, Artificial Sequence
  Description of Artificial Sequence: example ZFP
RSDNLTQ

SEQ ID NO: 3785 - protein, 7 aa, Artificial Sequence
  Description of Artificial Sequence: example ZFP
RSDNLRE

SEQ ID NO: 3786 - protein, 7 aa, Artificial Sequence
  Description of Artificial Sequence: example ZFP
RSDALTQ

SEQ ID NO: 3787 - protein, 7 aa, Artificial Sequence
  Description of Artificial Sequence: example ZFP
RSDALTQ

SEQ ID NO: 3788 - protein, 7 aa, Artificial Sequence
  Description of Artificial Sequence: example ZFP
QSGNLAR

SEQ ID NO: 3789 - protein, 7 aa, Artificial Sequence
  Description of Artificial Sequence: example ZFP
RSDDLTQ

SEQ ID NO: 3790 - protein, 7 aa, Artificial Sequence
  Description of Artificial Sequence: example ZFP
RSDNLTQ

SEQ ID NO: 3791 - protein, 7 aa, Artificial Sequence
  Description of Artificial Sequence: example ZFP
RSDNLTQ

SEQ ID NO: 3792 - protein, 7 aa, Artificial Sequence
  Description of Artificial Sequence: example ZFP
RSDNLTQ

SEQ ID NO: 3793 - protein, 7 aa, Artificial Sequence
  Description of Artificial Sequence: example ZFP
RSDHLTT

SEQ ID NO: 3794 - protein, 7 aa, Artificial Sequence
  Description of Artificial Sequence: example ZFP
RSDHLTT

SEQ ID NO: 3795 - protein, 7 aa, Artificial Sequence
  Description of Artificial Sequence: example ZFP
RSDNLAR

SEQ ID NO: 3796 - protein, 7 aa, Artificial Sequence
  Description of Artificial Sequence: example ZFP
RSDNLAR

SEQ ID NO: 3797 - protein, 7 aa, Artificial Sequence
  Description of Artificial Sequence: example ZFP
QSGNLAR

SEQ ID NO: 3798 - protein, 7 aa, Artificial Sequence
  Description of Artificial Sequence: example ZFP
RSDALRE

SEQ ID NO: 3799 - protein, 7 aa, Artificial Sequence
  Description of Artificial Sequence: example ZFP
RSDNLKD

SEQ ID NO: 3800 - protein, 7 aa, Artificial Sequence
  Description of Artificial Sequence: example ZFP
RSDHLSR

SEQ ID NO: 3801 - protein, 7 aa, Artificial Sequence
  Description of Artificial Sequence: example ZFP
RSDNLAR

SEQ ID NO: 3802 - protein, 7 aa, Artificial Sequence
  Description of Artificial Sequence: example ZFP
RSDHLSR

SEQ ID NO: 3803 - protein, 7 aa, Artificial Sequence
  Description of Artificial Sequence: example ZFP
RSDHLSR

SEQ ID NO: 3804 - protein, 7 aa, Artificial Sequence
  Description of Artificial Sequence: example ZFP
DRSALAR

SEQ ID NO: 3805 - protein, 7 aa, Artificial Sequence
  Description of Artificial Sequence: example ZFP
DSGSLTR

SEQ ID NO: 3806 - protein, 7 aa, Artificial Sequence
  Description of Artificial Sequence: example ZFP
RSDALTR

SEQ ID NO: 3807 - protein, 7 aa, Artificial Sequence
  Description of Artificial Sequence: example ZFP
RSDALTR

SEQ ID NO: 3808 - protein, 7 aa, Artificial Sequence
  Description of Artificial Sequence: example ZFP
DRSALAR

SEQ ID NO: 3809 - protein, 7 aa, Artificial Sequence
  Description of Artificial Sequence: example ZFP
RSDTLRE

SEQ ID NO: 3810 - protein, 7 aa, Artificial Sequence
  Description of Artificial Sequence: example ZFP
QSGNLAR

SEQ ID NO: 3811 - protein, 7 aa, Artificial Sequence
  Description of Artificial Sequence: example ZFP
RSDTLRE

SEQ ID NO: 3812 - protein, 7 aa, Artificial Sequence
  Description of Artificial Sequence: example ZFP
RSDTLRE

SEQ ID NO: 3813 - protein, 7 aa, Artificial Sequence
  Description of Artificial Sequence: example ZFP
RSDTLKQ

SEQ ID NO: 3814 - protein, 7 aa, Artificial Sequence
  Description of Artificial Sequence: example ZFP
RSDHLSR

SEQ ID NO: 3815 - protein, 7 aa, Artificial Sequence
  Description of Artificial Sequence: example ZFP
RSDHLSR

SEQ ID NO: 3816 - protein, 7 aa, Artificial Sequence
  Description of Artificial Sequence: example ZFP
RSDHLSR

SEQ ID NO: 3817 - protein, 7 aa, Artificial Sequence
  Description of Artificial Sequence: example ZFP
RSDNLAR

SEQ ID NO: 3818 - protein, 7 aa, Artificial Sequence
  Description of Artificial Sequence: example ZFP
RSDNLAR

SEQ ID NO: 3819 - protein, 7 aa, Artificial Sequence
  Description of Artificial Sequence: example ZFP
RRDTLHR

SEQ ID NO: 3820 - protein, 7 aa, Artificial Sequence
  Description of Artificial Sequence: example ZFP
RLDTLGR

SEQ ID NO: 3821 - protein, 7 aa, Artificial Sequence
  Description of Artificial Sequence: example ZFP
DSGHLAS

SEQ ID NO: 3822 - protein, 7 aa, Artificial Sequence
  Description of Artificial Sequence: example ZFP
RSDNLTQ

SEQ ID NO: 3823 - protein, 7 aa, Artificial Sequence
  Description of Artificial Sequence: example ZFP
RSDNLTQ

SEQ ID NO: 3824 - protein, 7 aa, Artificial Sequence
  Description of Artificial Sequence: example ZFP
RSDNLRE

SEQ ID NO: 3825 - protein, 7 aa, Artificial Sequence
  Description of Artificial Sequence: example ZFP
RSDNLTT

SEQ ID NO: 3826 - protein, 7 aa, Artificial Sequence
  Description of Artificial Sequence: example ZFP
RSDALRE

SEQ ID NO: 3827 - protein, 7 aa, Artificial Sequence
  Description of Artificial Sequence: example ZFP
RSDALRE

SEQ ID NO: 3828 - protein, 7 aa, Artificial Sequence
  Description of Artificial Sequence: example ZFP
RSDALTK

SEQ ID NO: 3829 - protein, 7 aa, Artificial Sequence
  Description of Artificial Sequence: example ZFP
RSDALTR

SEQ ID NO: 3830 - protein, 7 aa, Artificial Sequence
  Description of Artificial Sequence: example ZFP
RSDNLRE

SEQ ID NO: 3831 - protein, 7 aa, Artificial Sequence
  Description of Artificial Sequence: example ZFP
RSDNLRE

SEQ ID NO: 3832 - protein, 7 aa, Artificial Sequence
  Description of Artificial Sequence: example ZFP
QSGSLTR

SEQ ID NO: 3833 - protein, 7 aa, Artificial Sequence
  Description of Artificial Sequence: example ZFP
QSGSLTR

SEQ ID NO: 3834 - protein, 7 aa, Artificial Sequence
  Description of Artificial Sequence: example ZFP
RSDNLTT

SEQ ID NO: 3835 - protein, 7 aa, Artificial Sequence
  Description of Artificial Sequence: example ZFP
QSGNLTR

SEQ ID NO: 3836 - protein, 7 aa, Artificial Sequence
  Description of Artificial Sequence: example ZFP
RSDNLAR

SEQ ID NO: 3837 - protein, 7 aa, Artificial Sequence
  Description of Artificial Sequence: example ZFP
RSDNLAR

SEQ ID NO: 3838 - protein, 7 aa, Artificial Sequence
  Description of Artificial Sequence: example ZFP
RSDELRT

SEQ ID NO: 3839 - protein, 7 aa, Artificial Sequence
  Description of Artificial Sequence: example ZFP
RSDALTR

SEQ ID NO: 3840 - protein, 7 aa, Artificial Sequence
  Description of Artificial Sequence: example ZFP
RSDNLTE

SEQ ID NO: 3841 - protein, 7 aa, Artificial Sequence
  Description of Artificial Sequence: example ZFP
RSDNLTK

SEQ ID NO: 3842 - protein, 7 aa, Artificial Sequence
  Description of Artificial Sequence: example ZFP
RSDALTR

SEQ ID NO: 3843 - protein, 7 aa, Artificial Sequence
  Description of Artificial Sequence: example ZFP
RSDALTR

SEQ ID NO: 3844 - protein, 7 aa, Artificial Sequence
  Description of Artificial Sequence: example ZFP
RSDALTT

SEQ ID NO: 3845 - protein, 7 aa, Artificial Sequence
  Description of Artificial Sequence: example ZFP
RSDNLTQ

SEQ ID NO: 3846 - protein, 7 aa, Artificial Sequence
  Description of Artificial Sequence: example ZFP
RSDNLTQ

SEQ ID NO: 3847 - protein, 7 aa, Artificial Sequence
  Description of Artificial Sequence: example ZFP
RSDNLTE

SEQ ID NO: 3848 - protein, 7 aa, Artificial Sequence
  Description of Artificial Sequence: example ZFP
RSDNLTE

SEQ ID NO: 3849 - protein, 7 aa, Artificial Sequence
  Description of Artificial Sequence: example ZFP
RSDNLTK

SEQ ID NO: 3850 - protein, 7 aa, Artificial Sequence
  Description of Artificial Sequence: example ZFP
RSDNLTE

SEQ ID NO: 3851 - protein, 7 aa, Artificial Sequence
  Description of Artificial Sequence: example ZFP
DRSALAR

SEQ ID NO: 3852 - protein, 7 aa, Artificial Sequence
  Description of Artificial Sequence: example ZFP
RSDTLRE

SEQ ID NO: 3853 - protein, 7 aa, Artificial Sequence
  Description of Artificial Sequence: example ZFP
RSDNLTT

SEQ ID NO: 3854 - protein, 7 aa, Artificial Sequence
  Description of Artificial Sequence: example ZFP
RSDALRE

SEQ ID NO: 3855 - protein, 7 aa, Artificial Sequence
  Description of Artificial Sequence: example ZFP
RSDHLTT

SEQ ID NO: 3856 - protein, 7 aa, Artificial Sequence
  Description of Artificial Sequence: example ZFP
RSDNLTT

SEQ ID NO: 3857 - protein, 7 aa, Artificial Sequence
  Description of Artificial Sequence: example ZFP
RSDNLTT

SEQ ID NO: 3858 - protein, 7 aa, Artificial Sequence
  Description of Artificial Sequence: example ZFP
RSDHLTT

SEQ ID NO: 3859 - protein, 7 aa, Artificial Sequence
  Description of Artificial Sequence: example ZFP
RSDHLSR

SEQ ID NO: 3860 - protein, 7 aa, Artificial Sequence
  Description of Artificial Sequence: example ZFP
RSDHLSR

SEQ ID NO: 3861 - protein, 7 aa, Artificial Sequence
  Description of Artificial Sequence: example ZFP
QSSSLVR

SEQ ID NO: 3862 - protein, 7 aa, Artificial Sequence
  Description of Artificial Sequence: example ZFP
QSSSLVR

SEQ ID NO: 3863 - protein, 7 aa, Artificial Sequence
  Description of Artificial Sequence: example ZFP
RSDALAQ

SEQ ID NO: 3864 - protein, 7 aa, Artificial Sequence
  Description of Artificial Sequence: example ZFP
RSDALAQ

SEQ ID NO: 3865 - protein, 7 aa, Artificial Sequence
  Description of Artificial Sequence: example ZFP
RSDALTT

SEQ ID NO: 3866 - protein, 7 aa, Artificial Sequence
  Description of Artificial Sequence: example ZFP
RADALMV

SEQ ID NO: 3867 - protein, 7 aa, Artificial Sequence
  Description of Artificial Sequence: example ZFP
RSDALTR

SEQ ID NO: 3868 - protein, 7 aa, Artificial Sequence
  Description of Artificial Sequence: example ZFP
RSDALTR

SEQ ID NO: 3869 - protein, 7 aa, Artificial Sequence
  Description of Artificial Sequence: example ZFP
RSDALTR

SEQ ID NO: 3870 - protein, 7 aa, Artificial Sequence
  Description of Artificial Sequence: example ZFP
RSDALTK

SEQ ID NO: 3871 - protein, 7 aa, Artificial Sequence
  Description of Artificial Sequence: example ZFP
RSDALTK

SEQ ID NO: 3872 - protein, 7 aa, Artificial Sequence
  Description of Artificial Sequence: example ZFP
RSDALTT

SEQ ID NO: 3873 - protein, 7 aa, Artificial Sequence
  Description of Artificial Sequence: example ZFP
RSDALTT

SEQ ID NO: 3874 - protein, 7 aa, Artificial Sequence
  Description of Artificial Sequence: example ZFP
RSDALRE

SEQ ID NO: 3875 - protein, 7 aa, Artificial Sequence
  Description of Artificial Sequence: example ZFP
RSDNLAR

SEQ ID NO: 3876 - protein, 7 aa, Artificial Sequence
  Description of Artificial Sequence: example ZFP
RSDALRE

SEQ ID NO: 3877 - protein, 7 aa, Artificial Sequence
  Description of Artificial Sequence: example ZFP
RSDDLRE

SEQ ID NO: 3878 - protein, 7 aa, Artificial Sequence
  Description of Artificial Sequence: example ZFP
DSSNLTR

SEQ ID NO: 3879 - protein, 7 aa, Artificial Sequence
  Description of Artificial Sequence: example ZFP
RSDHLAE

SEQ ID NO: 3880 - protein, 7 aa, Artificial Sequence
  Description of Artificial Sequence: example ZFP
RSDHLAE

SEQ ID NO: 3881 - protein, 7 aa, Artificial Sequence
  Description of Artificial Sequence: example ZFP
RSDHLSR

SEQ ID NO: 3882 - protein, 7 aa, Artificial Sequence
  Description of Artificial Sequence: example ZFP
RSDHLSR

SEQ ID NO: 3883 - protein, 7 aa, Artificial Sequence
  Description of Artificial Sequence: example ZFP
RSHHLSR

SEQ ID NO: 3884 - protein, 7 aa, Artificial Sequence
  Description of Artificial Sequence: example ZFP
RSHHLSR

SEQ ID NO: 3885 - protein, 7 aa, Artificial Sequence
  Description of Artificial Sequence: example ZFP
RSDNLTE

SEQ ID NO: 3886 - protein, 7 aa, Artificial Sequence
  Description of Artificial Sequence: example ZFP
RSDNLTE

SEQ ID NO: 3887 - protein, 7 aa, Artificial Sequence
  Description of Artificial Sequence: example ZFP
RSDTLRE

SEQ ID NO: 3888 - protein, 7 aa, Artificial Sequence
  Description of Artificial Sequence: example ZFP
TSANLSR

SEQ ID NO: 3889 - protein, 7 aa, Artificial Sequence
  Description of Artificial Sequence: example ZFP
RSDNLTE

SEQ ID NO: 3890 - protein, 7 aa, Artificial Sequence
  Description of Artificial Sequence: example ZFP
RSDHLSR

SEQ ID NO: 3891 - protein, 7 aa, Artificial Sequence
  Description of Artificial Sequence: example ZFP
RSDNLTE

SEQ ID NO: 3892 - protein, 7 aa, Artificial Sequence
  Description of Artificial Sequence: example ZFP
RSDHLSR

SEQ ID NO: 3893 - protein, 7 aa, Artificial Sequence
  Description of Artificial Sequence: example ZFP
RSDALTR

SEQ ID NO: 3894 - protein, 7 aa, Artificial Sequence
  Description of Artificial Sequence: example ZFP
RSDALRE

SEQ ID NO: 3895 - protein, 7 aa, Artificial Sequence
  Description of Artificial Sequence: example ZFP
RSDALRE

SEQ ID NO: 3896 - protein, 7 aa, Artificial Sequence
  Description of Artificial Sequence: example ZFP
QSSDLTR

SEQ ID NO: 3897 - protein, 7 aa, Artificial Sequence
  Description of Artificial Sequence: example ZFP
QSSDLTR

SEQ ID NO: 3898 - protein, 7 aa, Artificial Sequence
  Description of Artificial Sequence: example ZFP
DRSNLTR

SEQ ID NO: 3899 - protein, 7 aa, Artificial Sequence
  Description of Artificial Sequence: example ZFP
DRSNLTR

SEQ ID NO: 3900 - protein, 7 aa, Artificial Sequence
  Description of Artificial Sequence: example ZFP
RSDNLTE

SEQ ID NO: 3901 - protein, 7 aa, Artificial Sequence
  Description of Artificial Sequence: example ZFP
RSDNLTQ

SEQ ID NO: 3902 - protein, 7 aa, Artificial Sequence
  Description of Artificial Sequence: example ZFP
RSDNLTQ

SEQ ID NO: 3903 - protein, 7 aa, Artificial Sequence
  Description of Artificial Sequence: example ZFP
RSDNLTQ

SEQ ID NO: 3904 - protein, 7 aa, Artificial Sequence
  Description of Artificial Sequence: example ZFP
RSDALAQ

SEQ ID NO: 3905 - protein, 7 aa, Artificial Sequence
  Description of Artificial Sequence: example ZFP
RSDALAQ

SEQ ID NO: 3906 - protein, 7 aa, Artificial Sequence
  Description of Artificial Sequence: example ZFP
RSDALAQ

SEQ ID NO: 3907 - protein, 7 aa, Artificial Sequence
  Description of Artificial Sequence: example ZFP
RSDALAQ

SEQ ID NO: 3908 - protein, 7 aa, Artificial Sequence
  Description of Artificial Sequence: example ZFP
RSDALRE

SEQ ID NO: 3909 - protein, 7 aa, Artificial Sequence
  Description of Artificial Sequence: example ZFP
RSDALRE

SEQ ID NO: 3910 - protein, 7 aa, Artificial Sequence
  Description of Artificial Sequence: example ZFP
RSDALTR

SEQ ID NO: 3911 - protein, 7 aa, Artificial Sequence
  Description of Artificial Sequence: example ZFP
RSDELRE

SEQ ID NO: 3912 - protein, 7 aa, Artificial Sequence
  Description of Artificial Sequence: example ZFP
RSDELRE

SEQ ID NO: 3913 - protein, 7 aa, Artificial Sequence
  Description of Artificial Sequence: example ZFP
RSDELRE

SEQ ID NO: 3914 - protein, 7 aa, Artificial Sequence
  Description of Artificial Sequence: example ZFP
RSDDLRE

SEQ ID NO: 3915 - protein, 7 aa, Artificial Sequence
  Description of Artificial Sequence: example ZFP
RSDDLRE

SEQ ID NO: 3916 - protein, 7 aa, Artificial Sequence
  Description of Artificial Sequence: example ZFP
RSDDLRE

SEQ ID NO: 3917 - protein, 7 aa, Artificial Sequence
  Description of Artificial Sequence: example ZFP
ERGDLTR

SEQ ID NO: 3918 - protein, 7 aa, Artificial Sequence
  Description of Artificial Sequence: example ZFP
ERGDLTR

SEQ ID NO: 3919 - protein, 7 aa, Artificial Sequence
  Description of Artificial Sequence: example ZFP
DCRDLAR

SEQ ID NO: 3920 - protein, 7 aa, Artificial Sequence
  Description of Artificial Sequence: example ZFP
DCRDLAR

SEQ ID NO: 3921 - protein, 7 aa, Artificial Sequence
  Description of Artificial Sequence: example ZFP
MSHHLSR

SEQ ID NO: 3922 - protein, 7 aa, Artificial Sequence
  Description of Artificial Sequence: example ZFP
RSDHLTT

SEQ ID NO: 3923 - protein, 7 aa, Artificial Sequence
  Description of Artificial Sequence: example ZFP
RSDHLTT

SEQ ID NO: 3924 - protein, 7 aa, Artificial Sequence
  Description of Artificial Sequence: example ZFP
RSDALRE

SEQ ID NO: 3925 - protein, 7 aa, Artificial Sequence
  Description of Artificial Sequence: example ZFP
RSDHLTT

SEQ ID NO: 3926 - protein, 7 aa, Artificial Sequence
  Description of Artificial Sequence: example ZFP
RSDHLTK

SEQ ID NO: 3927 - protein, 7 aa, Artificial Sequence
  Description of Artificial Sequence: example ZFP
QSGNLAR

SEQ ID NO: 3928 - protein, 7 aa, Artificial Sequence
  Description of Artificial Sequence: example ZFP
QSGNLAR

SEQ ID NO: 3929 - protein, 7 aa, Artificial Sequence
  Description of Artificial Sequence: example ZFP
QSGNLAR

SEQ ID NO: 3930 - protein, 7 aa, Artificial Sequence
  Description of Artificial Sequence: example ZFP
QSGNLRT

SEQ ID NO: 3931 - protein, 7 aa, Artificial Sequence
  Description of Artificial Sequence: example ZFP
RSDHLTT

SEQ ID NO: 3932 - protein, 7 aa, Artificial Sequence
  Description of Artificial Sequence: example ZFP
RSDDLRE

SEQ ID NO: 3933 - protein, 7 aa, Artificial Sequence
  Description of Artificial Sequence: example ZFP
RSDNLAR

SEQ ID NO: 3934 - protein, 7 aa, Artificial Sequence
  Description of Artificial Sequence: example ZFP
RSDALRE

SEQ ID NO: 3935 - protein, 7 aa, Artificial Sequence
  Description of Artificial Sequence: example ZFP
RSDALTQ

SEQ ID NO: 3936 - protein, 7 aa, Artificial Sequence
  Description of Artificial Sequence: example ZFP
RSDNLAR

SEQ ID NO: 3937 - protein, 7 aa, Artificial Sequence
  Description of Artificial Sequence: example ZFP
RSDNLAR

SEQ ID NO: 3938 - protein, 7 aa, Artificial Sequence
  Description of Artificial Sequence: example ZFP
QSGNLAR

SEQ ID NO: 3939 - protein, 7 aa, Artificial Sequence
  Description of Artificial Sequence: example ZFP
RSDERKR

SEQ ID NO: 3940 - protein, 7 aa, Artificial Sequence
  Description of Artificial Sequence: example ZFP
RSDELRE

SEQ ID NO: 3941 - protein, 7 aa, Artificial Sequence
  Description of Artificial Sequence: example ZFP
RSDDLRE

SEQ ID NO: 3942 - protein, 7 aa, Artificial Sequence
  Description of Artificial Sequence: example ZFP
RSDELRE

SEQ ID NO: 3943 - protein, 7 aa, Artificial Sequence
  Description of Artificial Sequence: example ZFP
QSGHLTK

SEQ ID NO: 3944 - protein, 7 aa, Artificial Sequence
  Description of Artificial Sequence: example ZFP
RSDALRE

SEQ ID NO: 3945 - protein, 7 aa, Artificial Sequence
  Description of Artificial Sequence: example ZFP
RSDALRE

SEQ ID NO: 3946 - protein, 7 aa, Artificial Sequence
  Description of Artificial Sequence: example ZFP
RSDALRE

SEQ ID NO: 3947 - protein, 7 aa, Artificial Sequence
  Description of Artificial Sequence: example ZFP
RSDELQR

SEQ ID NO: 3948 - protein, 7 aa, Artificial Sequence
  Description of Artificial Sequence: example ZFP
RSDELQR

SEQ ID NO: 3949 - protein, 7 aa, Artificial Sequence
  Description of Artificial Sequence: example ZFP
RSDNLAR

SEQ ID NO: 3950 - protein, 7 aa, Artificial Sequence
  Description of Artificial Sequence: example ZFP
RSDALRE

SEQ ID NO: 3951 - protein, 7 aa, Artificial Sequence
  Description of Artificial Sequence: example ZFP
RSDHLSR

SEQ ID NO: 3952 - protein, 7 aa, Artificial Sequence
  Description of Artificial Sequence: example ZFP
RSDHLSR

SEQ ID NO: 3953 - protein, 7 aa, Artificial Sequence
  Description of Artificial Sequence: example ZFP
RSDNLRE

SEQ ID NO: 3954 - protein, 7 aa, Artificial Sequence
  Description of Artificial Sequence: example ZFP
RSDNLTE

SEQ ID NO: 3955 - protein, 7 aa, Artificial Sequence
  Description of Artificial Sequence: example ZFP
QSVHLQS

SEQ ID NO: 3956 - protein, 7 aa, Artificial Sequence
  Description of Artificial Sequence: example ZFP
QSGHLTT

SEQ ID NO: 3957 - protein, 7 aa, Artificial Sequence
  Description of Artificial Sequence: example ZFP
RSDDLTK

SEQ ID NO: 3958 - protein, 7 aa, Artificial Sequence
  Description of Artificial Sequence: example ZFP
RSDDLAS

SEQ ID NO: 3959 - protein, 7 aa, Artificial Sequence
  Description of Artificial Sequence: example ZFP
RSDDLTK

SEQ ID NO: 3960 - protein, 7 aa, Artificial Sequence
  Description of Artificial Sequence: example ZFP
RSDALRE

SEQ ID NO: 3961 - protein, 7 aa, Artificial Sequence
  Description of Artificial Sequence: example ZFP
QSGNLTK

SEQ ID NO: 3962 - protein, 7 aa, Artificial Sequence
  Description of Artificial Sequence: example ZFP
RSDHLTT

SEQ ID NO: 3963 - protein, 7 aa, Artificial Sequence
  Description of Artificial Sequence: example ZFP
QSGHLQR

SEQ ID NO: 3964 - protein, 7 aa, Artificial Sequence
  Description of Artificial Sequence: example ZFP
QSGHLQR

SEQ ID NO: 3965 - protein, 7 aa, Artificial Sequence
  Description of Artificial Sequence: example ZFP
QSGALTQ

SEQ ID NO: 3966 - protein, 7 aa, Artificial Sequence
  Description of Artificial Sequence: example ZFP
DRSHLTK

SEQ ID NO: 3967 - protein, 7 aa, Artificial Sequence
  Description of Artificial Sequence: example ZFP
RSHHLTT

SEQ ID NO: 3968 - protein, 7 aa, Artificial Sequence
  Description of Artificial Sequence: example ZFP
RSSHLTT

SEQ ID NO: 3969 - protein, 7 aa, Artificial Sequence
  Description of Artificial Sequence: example ZFP
RSHHLTT

SEQ ID NO: 3970 - protein, 7 aa, Artificial Sequence
  Description of Artificial Sequence: example ZFP
RSSHLTT

SEQ ID NO: 3971 - protein, 7 aa, Artificial Sequence
  Description of Artificial Sequence: example ZFP
QSGHLQR

SEQ ID NO: 3972 - protein, 7 aa, Artificial Sequence
  Description of Artificial Sequence: example ZFP
RSDHLRE

SEQ ID NO: 3973 - protein, 7 aa, Artificial Sequence
  Description of Artificial Sequence: example ZFP
QRAHLAR

SEQ ID NO: 3974 - protein, 7 aa, Artificial Sequence
  Description of Artificial Sequence: example ZFP
QSGSLTR

SEQ ID NO: 3975 - protein, 7 aa, Artificial Sequence
  Description of Artificial Sequence: example ZFP
RADALMV

SEQ ID NO: 3976 - protein, 7 aa, Artificial Sequence
  Description of Artificial Sequence: example ZFP
DRSNLTR

SEQ ID NO: 3977 - protein, 7 aa, Artificial Sequence
  Description of Artificial Sequence: example ZFP
RSDHLRE

SEQ ID NO: 3978 - protein, 7 aa, Artificial Sequence
  Description of Artificial Sequence: example ZFP
RSDNLAR

SEQ ID NO: 3979 - protein, 7 aa, Artificial Sequence
  Description of Artificial Sequence: example ZFP
DRSNLTR

SEQ ID NO: 3980 - protein, 7 aa, Artificial Sequence
  Description of Artificial Sequence: example ZFP
RSDALRE

SEQ ID NO: 3981 - protein, 7 aa, Artificial Sequence
  Description of Artificial Sequence: example ZFP
RSDALRE

SEQ ID NO: 3982 - protein, 7 aa, Artificial Sequence
  Description of Artificial Sequence: example ZFP
MSHHLSR

SEQ ID NO: 3983 - protein, 7 aa, Artificial Sequence
  Description of Artificial Sequence: example ZFP
TSGHLVR

SEQ ID NO: 3984 - protein, 7 aa, Artificial Sequence
  Description of Artificial Sequence: example ZFP
QRAHLER

SEQ ID NO: 3985 - protein, 7 aa, Artificial Sequence
  Description of Artificial Sequence: example ZFP
RSDALRE

SEQ ID NO: 3986 - protein, 7 aa, Artificial Sequence
  Description of Artificial Sequence: example ZFP
RADALMV

SEQ ID NO: 3987 - protein, 7 aa, Artificial Sequence
  Description of Artificial Sequence: example ZFP
RSDSLTT

SEQ ID NO: 3988 - protein, 7 aa, Artificial Sequence
  Description of Artificial Sequence: example ZFP
RADALMV

SEQ ID NO: 3989 - protein, 7 aa, Artificial Sequence
  Description of Artificial Sequence: example ZFP
RLHSLTT

SEQ ID NO: 3990 - protein, 7 aa, Artificial Sequence
  Description of Artificial Sequence: example ZFP
RSDSLTT

SEQ ID NO: 3991 - protein, 7 aa, Artificial Sequence
  Description of Artificial Sequence: example ZFP
QSGSLTR

SEQ ID NO: 3992 - protein, 7 aa, Artificial Sequence
  Description of Artificial Sequence: example ZFP
QSGNLAR

SEQ ID NO: 3993 - protein, 7 aa, Artificial Sequence
  Description of Artificial Sequence: example ZFP
QSGNLAR

SEQ ID NO: 3994 - protein, 7 aa, Artificial Sequence
  Description of Artificial Sequence: example ZFP
RSDELRE

SEQ ID NO: 3995 - protein, 7 aa, Artificial Sequence
  Description of Artificial Sequence: example ZFP
RSDELRE

SEQ ID NO: 3996 - protein, 7 aa, Artificial Sequence
  Description of Artificial Sequence: example ZFP
RSDELRE

SEQ ID NO: 3997 - protein, 7 aa, Artificial Sequence
  Description of Artificial Sequence: example ZFP
QSGNLAR

SEQ ID NO: 3998 - protein, 7 aa, Artificial Sequence
  Description of Artificial Sequence: example ZFP
RSDNLTQ

SEQ ID NO: 3999 - protein, 7 aa, Artificial Sequence
  Description of Artificial Sequence: example ZFP
RSDHLSR

SEQ ID NO: 4000 - protein, 7 aa, Artificial Sequence
  Description of Artificial Sequence: example ZFP
RLHSLTT

SEQ ID NO: 4001 - protein, 7 aa, Artificial Sequence
  Description of Artificial Sequence: example ZFP
RLDNRTQ

SEQ ID NO: 4002 - protein, 7 aa, Artificial Sequence
  Description of Artificial Sequence: example ZFP
RSDALRE

SEQ ID NO: 4003 - protein, 7 aa, Artificial Sequence
  Description of Artificial Sequence: example ZFP
RLDNRTA

SEQ ID NO: 4004 - protein, 7 aa, Artificial Sequence
  Description of Artificial Sequence: example ZFP
RSDNLTQ

SEQ ID NO: 4005 - protein, 7 aa, Artificial Sequence
  Description of Artificial Sequence: example ZFP
RLDNRTQ

SEQ ID NO: 4006 - protein, 7 aa, Artificial Sequence
  Description of Artificial Sequence: example ZFP
RSDHLSR

SEQ ID NO: 4007 - protein, 7 aa, Artificial Sequence
  Description of Artificial Sequence: example ZFP
RSDALTT

SEQ ID NO: 4008 - protein, 7 aa, Artificial Sequence
  Description of Artificial Sequence: example ZFP
RSDNLAR

SEQ ID NO: 4009 - protein, 7 aa, Artificial Sequence
  Description of Artificial Sequence: example ZFP
RSDNLAR

SEQ ID NO: 4010 - protein, 7 aa, Artificial Sequence
  Description of Artificial Sequence: example ZFP
RSDNLAR

SEQ ID NO: 4011 - protein, 7 aa, Artificial Sequence
  Description of Artificial Sequence: example ZFP
QSGSLTR

SEQ ID NO: 4012 - protein, 7 aa, Artificial Sequence
  Description of Artificial Sequence: example ZFP
QSGDLTR

SEQ ID NO: 4013 - protein, 7 aa, Artificial Sequence
  Description of Artificial Sequence: example ZFP
  MOD_RES (2): variable amino acid
  MOD_RES (5)..(6): variable amino acid
DXSNXXR

SEQ ID NO: 4014 - protein, 7 aa, Artificial Sequence
  Description of Artificial Sequence: example ZFP
  MOD_RES (2): variable amino acid
  MOD_RES (5)..(6): variable amino acid
RXDNXXR

SEQ ID NO: 4015 - protein, 7 aa, Artificial Sequence
  Description of Artificial Sequence: example ZFP
  MOD_RES (2): variable amino acid
  MOD_RES (5)..(6): variable amino acid
QXSNXXR

SEQ ID NO: 4016 - protein, 7 aa, Artificial Sequence
  Description of Artificial Sequence: example ZFP
  MOD_RES (2): variable amino acid
  MOD_RES (5)..(6): variable amino acid
TXSNXXR

SEQ ID NO: 4017 - protein, 7 aa, Artificial Sequence
  Description of Artificial Sequence: example ZFP
  MOD_RES (2): variable amino acid
  MOD_RES (5)..(6): variable amino acid
TXGNXXR

SEQ ID NO: 4018 - protein, 7 aa, Artificial Sequence
  Description of Artificial Sequence: example ZFP
  MOD_RES (2): variable amino acid
  MOD_RES (5)..(6): variable amino acid
QXGSXXR

SEQ ID NO: 4019 - protein, 7 aa, Artificial Sequence
  Description of Artificial Sequence: example ZFP
  MOD_RES (2): variable amino acid
  MOD_RES (5)..(6): variable amino acid
EXGTXXR

SEQ ID NO: 4020 - protein, 7 aa, Artificial Sequence
  Description of Artificial Sequence: example ZFP
  MOD_RES (2): variable amino acid
  MOD_RES (5)..(6): variable amino acid
RXDEXXR

SEQ ID NO: 4021 - protein, 7 aa, Artificial Sequence
  Description of Artificial Sequence: example ZFP
  MOD_RES (2): variable amino acid
  MOD_RES (5)..(6): variable amino acid
QXSDXXR

SEQ ID NO: 4022 - protein, 7 aa, Artificial Sequence
  Description of Artificial Sequence: example ZFP
  MOD_RES (2): variable amino acid
  MOD_RES (5)..(6): variable amino acid
DXSHXXR

SEQ ID NO: 4023 - protein, 7 aa, Artificial Sequence
  Description of Artificial Sequence: example ZFP
  MOD_RES (2): variable amino acid
  MOD_RES (5)..(6): variable amino acid
RXDHXXR

SEQ ID NO: 4024 - protein, 7 aa, Artificial Sequence
  Description of Artificial Sequence: example ZFP
  MOD_RES (2): variable amino acid
  MOD_RES (5)..(6): variable amino acid
RXDAXXR

SEQ ID NO: 4025 - protein, 7 aa, Artificial Sequence
  Description of Artificial Sequence: example ZFP
  MOD_RES (2): variable amino acid
  MOD_RES (5)..(6): variable amino acid
RXDSXXR

SEQ ID NO: 4026 - protein, 7 aa, Artificial Sequence
  Description of Artificial Sequence: example ZFP
  MOD_RES (2): variable amino acid
  MOD_RES (5)..(6): variable amino acid
RXDDXXK

SEQ ID NO: 4027 - protein, 7 aa, Artificial Sequence
  Description of Artificial Sequence: example ZFP
  MOD_RES (2): variable amino acid
  MOD_RES (5)..(6): variable amino acid
QXGNXXR

SEQ ID NO: 4028 - protein, 7 aa, Artificial Sequence
  Description of Artificial Sequence: example ZFP
  MOD_RES (2): variable amino acid
  MOD_RES (5)..(6): variable amino acid
RXSNXXR

SEQ ID NO: 4029 - protein, 7 aa, Artificial Sequence
  Description of Artificial Sequence: example ZFP
  MOD_RES (2): variable amino acid
  MOD_RES (5)..(6): variable amino acid
RXDNXXR

SEQ ID NO: 4030 - protein, 7 aa, Artificial Sequence
  Description of Artificial Sequence: example ZFP
  MOD_RES (2): variable amino acid
  MOD_RES (5)..(6): variable amino acid
TXGNXXR

SEQ ID NO: 4031 - protein, 7 aa, Artificial Sequence
  Description of Artificial Sequence: example ZFP
  MOD_RES (2): variable amino acid
  MOD_RES (5)..(6): variable amino acid
QXGDXXR

SEQ ID NO: 4032 - protein, 7 aa, Artificial Sequence
  Description of Artificial Sequence: example ZFP
  MOD_RES (2): variable amino acid
  MOD_RES (5)..(6): variable amino acid
RXDEXXR

SEQ ID NO: 4033 - protein, 7 aa, Artificial Sequence
  Description of Artificial Sequence: example ZFP
  MOD_RES (2): variable amino acid
  MOD_RES (5)..(6): variable amino acid
TXGEXXR

SEQ ID NO: 4034 - protein, 7 aa, Artificial Sequence
  Description of Artificial Sequence: example ZFP
  MOD_RES (2): variable amino acid
  MOD_RES (5)..(6): variable amino acid
QXSDXXR

SEQ ID NO: 4035 - protein, 7 aa, Artificial Sequence
  Description of Artificial Sequence: example ZFP
  MOD_RES (2): variable amino acid
  MOD_RES (5)..(6): variable amino acid
QXGHXXR

SEQ ID NO: 4036 - protein, 7 aa, Artificial Sequence
  Description of Artificial Sequence: example ZFP
  MOD_RES (2): variable amino acid
  MOD_RES (5)..(6): variable amino acid
DXSHXXR

SEQ ID NO: 4037 - protein, 7 aa, Artificial Sequence
  Description of Artificial Sequence: example ZFP
  MOD_RES (2): variable amino acid
  MOD_RES (5)..(6): variable amino acid
RXDHXXR

SEQ ID NO: 4038 - protein, 7 aa, Artificial Sequence
  Description of Artificial Sequence: example ZFP
  MOD_RES (2): variable amino acid
  MOD_RES (5)..(6): variable amino acid
QXGSXXR

SEQ ID NO: 4039 - protein, 7 aa, Artificial Sequence
  Description of Artificial Sequence: example ZFP
  MOD_RES (2): variable amino acid
  MOD_RES (5)..(6): variable amino acid
QXATXXR

SEQ ID NO: 4040 - protein, 7 aa, Artificial Sequence
  Description of Artificial Sequence: example ZFP
  MOD_RES (2): variable amino acid
  MOD_RES (5)..(6): variable amino acid
RXDAXXR

SEQ ID NO: 4041 - protein, 7 aa, Artificial Sequence
  Description of Artificial Sequence: example ZFP
  MOD_RES (2): variable amino acid
  MOD_RES (5)..(6): variable amino acid
RXDNXXT

SEQ ID NO: 4042 - protein, 7 aa, Artificial Sequence
  Description of Artificial Sequence: example ZFP
  MOD_RES (2): variable amino acid
  MOD_RES (5)..(6): variable amino acid
TXDHXXS

SEQ ID NO: 4043 - protein, 7 aa, Artificial Sequence
  Description of Artificial Sequence: example ZFP
  MOD_RES (2): variable amino acid
  MOD_RES (5)..(6): variable amino acid
RXDHXXQ

SEQ ID NO: 4044 - protein, 7 aa, Artificial Sequence
  Description of Artificial Sequence: example ZFP
  MOD_RES (2): variable amino acid
  MOD_RES (5)..(6): variable amino acid
RXDAXXQ

SEQ ID NO: 4045 - protein, 7 aa, Artificial Sequence
  Description of Artificial Sequence: example ZFP
  MOD_RES (2): variable amino acid
  MOD_RES (5)..(6): variable amino acid
RXDHXXE

SEQ ID NO: 4046 - protein, 7 aa, Artificial Sequence
  Description of Artificial Sequence: example ZFP
  MOD_RES (2): variable amino acid
  MOD_RES (5)..(6): variable amino acid
DXSNXXR

SEQ ID NO: 4047 - protein, 7 aa, Artificial Sequence
  Description of Artificial Sequence: example ZFP
  MOD_RES (2): variable amino acid
  MOD_RES (5)..(6): variable amino acid
RXDNXXR

SEQ ID NO: 4048 - protein, 7 aa, Artificial Sequence
  Description of Artificial Sequence: example ZFP
  MOD_RES (2): variable amino acid
  MOD_RES (5)..(6): variable amino acid
RXDEXXR

SEQ ID NO: 4049 - protein, 7 aa, Artificial Sequence
  Description of Artificial Sequence: example ZFP
  MOD_RES (2): variable amino acid
  MOD_RES (5)..(6): variable amino acid
RXDTXXK

SEQ ID NO: 4050 - protein, 7 aa, Artificial Sequence
  Description of Artificial Sequence: example ZFP
  MOD_RES (2): variable amino acid
  MOD_RES (5)..(6): variable amino acid
QXAHXXR

SEQ ID NO: 4051 - protein, 7 aa, Artificial Sequence
  Description of Artificial Sequence: example ZFP
  MOD_RES (2): variable amino acid
  MOD_RES (5)..(6): variable amino acid
RXDHXXR

SEQ ID NO: 4052 - protein, 7 aa, Artificial Sequence
  Description of Artificial Sequence: example ZFP
  MOD_RES (2): variable amino acid
  MOD_RES (5)..(6): variable amino acid
RXDHXXK

SEQ ID NO: 4053 - protein, 7 aa, Artificial Sequence
  Description of Artificial Sequence: example ZFP
  MOD_RES (2): variable amino acid
  MOD_RES (5)..(6): variable amino acid
TXGHXXR

SEQ ID NO: 4054 - protein, 7 aa, Artificial Sequence
  Description of Artificial Sequence: example ZFP
  MOD_RES (2): variable amino acid
  MOD_RES (5)..(6): variable amino acid
RXDAXXR

SEQ ID NO: 4055 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDHXXQ

SEQ ID NO: 4056 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDAXXQ

SEQ ID NO: 4057 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDHXXE

SEQ ID NO: 4058 - protein, 7 aa, Artificial Sequence
  Description of Artificial Sequence:  zinc finger recognition helix sequence
  SITE (2): Xaa = any amino acid
  SITE (5)..(6): Xaa = any amino acid
QXGNXXR

SEQ ID NO: 4059 - protein, 7 aa, Artificial Sequence
  Description of Artificial Sequence:  zinc finger recognition helix sequence
  SITE (2): Xaa = any amino acid
  SITE (5)..(6): Xaa = any amino acid
DXSNXXR

SEQ ID NO: 4060 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDNXXR

SEQ ID NO: 4061 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXSNXXR

SEQ ID NO: 4062 - protein, 7 aa, Artificial Sequence
  Description of Artificial Sequence:  zinc finger recognition helix sequence
  SITE (2): Xaa = any amino acid
  SITE (5)..(6): Xaa = any amino acid
QXSNXXR

SEQ ID NO: 4063 - protein, 7 aa, Artificial Sequence
  Description of Artificial Sequence:  zinc finger recognition helix sequence
  SITE (2): Xaa = any amino acid
  SITE (5)..(6): Xaa = any amino acid
TXSNXXR

SEQ ID NO: 4064 - protein, 7 aa, Artificial Sequence
  Description of Artificial Sequence:  zinc finger recognition helix sequence
  SITE (2): Xaa = any amino acid
  SITE (5)..(6): Xaa = any amino acid
TXGNXXR

SEQ ID NO: 4065 - protein, 7 aa, Artificial Sequence
  Description of Artificial Sequence:  zinc finger recognition helix sequence
  SITE (2): Xaa = any amino acid
  SITE (5)..(6): Xaa = any amino acid
QXGSXXR

SEQ ID NO: 4066 - protein, 7 aa, Artificial Sequence
  Description of Artificial Sequence:  zinc finger recognition helix sequence
  SITE (2): Xaa = any amino acid
  SITE (5)..(6): Xaa = any amino acid
QXGDXXR

SEQ ID NO: 4067 - protein, 7 aa, Artificial Sequence
  Description of Artificial Sequence:  zinc finger recognition helix sequence
  SITE (2): Xaa = any amino acid
  SITE (5)..(6): Xaa = any amino acid
EXGTXXR

SEQ ID NO: 4068 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDEXXR

SEQ ID NO: 4069 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDTXXK

SEQ ID NO: 4070 - protein, 7 aa, Artificial Sequence
  Description of Artificial Sequence:  zinc finger recognition helix sequence
  SITE (2): Xaa = any amino acid
  SITE (5)..(6): Xaa = any amino acid
QXSDXXR

SEQ ID NO: 4071 - protein, 7 aa, Artificial Sequence
  Description of Artificial Sequence:  zinc finger recognition helix sequence
  SITE (2): Xaa = any amino acid
  SITE (5)..(6): Xaa = any amino acid
TXGEXXR

SEQ ID NO: 4072 - protein, 7 aa, Artificial Sequence
  Description of Artificial Sequence:  zinc finger recognition helix sequence
  SITE (2): Xaa = any amino acid
  SITE (5)..(6): Xaa = any amino acid
QXGHXXR

SEQ ID NO: 4073 - protein, 7 aa, Artificial Sequence
  Description of Artificial Sequence:  zinc finger recognition helix sequence
  SITE (2): Xaa = any amino acid
  SITE (5)..(6): Xaa = any amino acid
QXAHXXR

SEQ ID NO: 4074 - protein, 7 aa, Artificial Sequence
  Description of Artificial Sequence:  zinc finger recognition helix sequence
  SITE (2): Xaa = any amino acid
  SITE (5)..(6): Xaa = any amino acid
DXSHXXR

SEQ ID NO: 4075 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDHXXR

SEQ ID NO: 4076 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDHXXK

SEQ ID NO: 4077 - protein, 7 aa, Artificial Sequence
  Description of Artificial Sequence:  zinc finger recognition helix sequence
  SITE (2): Xaa = any amino acid
  SITE (5)..(6): Xaa = any amino acid
TXGHXXR

SEQ ID NO: 4078 - protein, 7 aa, Artificial Sequence
  Description of Artificial Sequence:  zinc finger recognition helix sequence
  SITE (2): Xaa = any amino acid
  SITE (5)..(6): Xaa = any amino acid
QXATXXR

SEQ ID NO: 4079 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDAXXR

SEQ ID NO: 4080 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDSXXR

SEQ ID NO: 4081 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDNXXT

SEQ ID NO: 4082 - protein, 7 aa, Artificial Sequence
  Description of Artificial Sequence:  zinc finger recognition helix sequence
  SITE (2): Xaa = any amino acid
  SITE (5)..(6): Xaa = any amino acid
RXDDXXK

SEQ ID NO: 4083 - protein, 7 aa, Artificial Sequence
  Description of Artificial Sequence:  zinc finger recognition helix sequence
  SITE (2): Xaa = any amino acid
  SITE (5)..(6): Xaa = any amino acid
TXDHXXS

SEQ ID NO: 4084 - protein, 4 aa, Artificial Sequence
  Description of Artificial Sequence:  D-able subsite
NNGK

SEQ ID NO: 4085 - protein, 7 aa, Artificial Sequence
  Description of Artificial Sequence:  zinc finger recognition helix sequence
  SITE (4): Xaa = any amino acid
  SITE (6): Xaa = any amino acid
RSDXLXR

What is claimed is:

1. A method for modulating expression of a gene in a cell, wherein the gene comprises a target site, wherein the target site comprises, in a 3' to 5' direction, a first (S1), a second (S2) and a third (S3) target subsites, each target subsite having the nucleotide sequence GNN, the method comprising:

introducing a polynucleotide encoding a zinc finger protein, into the cell, wherein:

(a) the zinc finger protein is a non-naturally-occurring zinc finger protein that has been engineered to bind the target site; and (b) the zinc finger protein comprises first (F1), second (F2), and third (F3) zinc fingers, ordered F1, F2, F3 from N-terminus to C-terminus that bind to (S1), (S2), and (S3), wherein if S1 comprises GAA, F1 comprises the amino acid sequence QRSNLVR (SEQ ID NO:158); if S1 comprises GAG, F1 comprises the amino acid sequence RSDNLAR (SEQ ID NO:130); if S1 comprises GAC, F1 comprises the amino acid sequence DRSNLTR (SEQ ID NO:395); if S1 comprises GAT, F1 comprises the amino acid sequence QSSNLAR (SEQ ID NO:1765); if S1 comprises GGA, F1 comprises the amino acid sequence QSGHLAR (SEQ ID NO:413); if S1 comprises GGG, F1 comprises the amino acid sequence RSDHLAR (SEQ ID NO:127); if S1 comprises GGC, F1 comprises the amino acid sequence DRSHLTR (SEQ ID NO:1506); if S1 comprises GGT, F1 comprises the amino acid sequence QSSHLTR (SEQ ID NO:835); if S1 comprises GCA, F1 comprises QSGSLTR (SEQ ID NO:342); if S1 comprises GCG, F1 comprises RSDDLTR (SEQ ID NO:188); if S1 comprises GCC, F1 comprises ERGTLAR (SEQ ID NO:131); if S1 comprises GCT, F1 comprises the amino acid sequence QSSDLTR (SEQ ID NO:1450); if S1 comprises GTA, F1 comprises the amino acid sequence QSGALTR (SEQ ID NO:1398); if S1 comprises GTG, F1 comprises the amino acid sequence RSDALTR (SEQ ID NO:153); if S1 comprises GTC, F1 comprises the amino acid sequence DRSALAR (SEQ ID NO:184); selecting the F2 zinc finger such that it binds to the S2 target subsite, wherein S2 comprises GAA, F2 comprises the amino acid sequence QSGNLAR (SEQ ID NO:801); if S2 comprises GAG, F2 comprises the amino acid sequence RSDNLAR (SEQ ID NO:130); if S2 comprises GAC, F2 comprises the amino acid sequence DRSNLTR (SEQ ID NO:395); if S2 comprises GAT, F2 comprises the amino acid sequence TSGNLVR (SEQ ID NO:1442); if S2 comprises GGA, F2 comprises the amino acid sequence QSGHLQR (SEQ ID NO:287); if S2 comprises GGG, F2 comprises the amino acid sequence RSDHLSR (SEQ ID NO:229); if S2 comprises GGC, F2 comprises the amino acid sequence DRSHLAR (SEQ ID NO:1092); if S2 comprises GGT, F2 comprises the amino acid sequence TSGHLSR (SEQ ID NO:1201); if S2 comprises GCA, F2 comprises the amino acid sequence QSGDLTR (SEQ ID NO:220); if S2 comprises GCG, F2 comprises the amino acid sequence RSDDLQR (SEQ ID NO:1844); if S2 comprises GCC, F2 comprises the amino acid sequence DRSDLTR (SEQ ID NO:417); if S2 comprises GCT, F2 comprises the amino acid sequence QSSDLTR (SEQ ID NO:1450); if S2 comprises GTA, F2 comprises the amino acid sequence QSGALAR (SEQ ID NO:3339); if S2 comprises GTG, F2 comprises the amino acid sequence RSDALSR (SEQ ID NO:237); if S2 comprises GTC, F2 comprises the amino acid sequence DRSALAR (SEQ ID NO: 184); and selecting the F3 zinc finger such that it binds to the S3 target subsite, wherein if S3 comprises GAA, F3 comprises the amino acid sequence QSGNLAR (SEQ ID NO:801); if S3 comprises GAG, F3 comprises the amino acid sequence RSDNLTR (SEQ ID NO:231); if S3 comprises GAC, F3 comprises the amino acid sequence DRSNLTR (SEQ ID NO:395); if S3 comprises GAT, F3 comprises the amino acid sequence TSANLSR (SEQ ID NO:377); if S3 comprises GGA, F3 comprises the amino acid sequence QSGHLQR (SEQ ID NO:287); if S3 comprises GGG, F3 comprises RSDHLSR (SEQ ID NO:229); if S3 comprises GGT, F3 comprises the amino acid sequence TSGHLVR (SEQ ID NO:1425); if S3 comprises GCA, F3 comprises the amino acid sequence QSGDLTR (SEQ ID NO:220); if S3 comprises GCG, F3 comprises the amino acid sequence RSDDLTR (SEQ ID NO:188); if S3 comprises GCC, F3 comprises the amino acid sequence DRSDLTR (SEQ ID NO:417); if S3 comprises GCT, F3 comprises the amino acid sequence QSSDLQR (SEQ ID NO:132); if S3 comprises GTG, F3 comprises RSDALTR (SEQ ID NO:153); and if S3 comprises GTC, F3 comprises the amino acid sequence DRSALAR (SEQ ID NO:184);

wherein the introduced polynucleotide expresses the zinc finger protein, and zinc finger protein binds to the target site, thereby modulating expression of the gene.

2. The method of claim 1, wherein the zinc finger protein further comprises a regulatory domain.

\* \* \* \* \*